United States Patent 8,216,786 (GENETIC POLYMORPHISMS ASSOCIATED WITH CARDIOVASCULAR DISEASES, METHODS OF DETECTION AND USES THEREOF) - sequence listing, part 4

SEQ ID NO: 1104 - DNA, 35513 bp, Homo sapiens
cgctccagcctgggtgacagagcaagattccatctataaataaataaataaataaagtcaatcaggactgccttctgcctgtgtgggcctggccaggctaagcagccacacaaccctccctacctgctgggccacccctggctgaaaacctctctggaatgcctctcttgggattgccttcagagattgcaacacattctccaaacaccctcagtggacatagactttgatccttgaagcagcagatttgactaagtaaaaaagaaaaagctattaaaaccagttggctgggcgcggtggctcacgcctgtaatcccagcactttgggaggccgaggcaggcggatcacgaggtcaggagatcgagactatcctggctaacacagtgaaaccccatctctaccaaaaatacaaaaaattagccgggcgtggtggtgggcgcctgtagtcccagctactcaggagactgaggcaggagaatggtgtgaacccgggaggtggagcttgcagtgagccgagatcgcgccactgcactccactccagcctggcgacagagctagactgtctcaaaaaaaaaaacagaggcgtgccaaagctcagcagaaaatgccgcctcatcactcttcctcttgccagtcttgtgggggcaccaaggcctagagtaacacccagctgttggcctgacagtgcctggcccagcctggagagttgcagccagaagtataaatgtggttcagtctgcgtcatacctgtcaggaaacatggtgagaccaactgctgcccagacggattttcaaaagaaatgggtcagaacgtattcccccacactggaatccctcagccagattgaggataaaaacaggcatcagaaaaaaatgatacaggcaggcctggtggctcatgcctgtaatcccagcactttgggaggctgaggcgggaggatcgcctgagcacaggagtttgagaccagcctgggcaacacagtgagaacctatctctactaaaaatagaacaattagccaggcacggtggtgtggctgtggtcccagctactctggaggctgaggtgggaggatcacttgagccctaggggtagaggctgcagtgagcggagatcaccccactgcaatccagcctgggcaacagatcaagaccctgtctcaaaaaaaaaaaaaagaaaagaaaacaaaagaaaaatatgatacactgactagaatgtgctttaaaataattggcatagttgggtatggtggcatgcacctgcagtctcacctacttggaaagctgtggccaggagtttgagaccagcctgggcaacacagcaagacctcatctctataaaaaataggcggggagcagtggctcacgcctgtaatcccagcactttgggaggccaaggcaggcggatcactagaggacaggagttcaagaccagcctggccaacatggtgaaaccccatctctactaaaaatacaaaaattggcaggatgtggtggcgggtgcctataatcccagctacttgggaggctgaggcaggagaatcgcttgaacctgggaggcagaggttgcagtgagccgaggtcatgacactgccctcaaacctgggtgacagagcaagactcggtctcgaaaaaaaaaataatgaatgaatgaattaattcattaattaaatagggggggtatatgagtttgttagggctgccgtaggagtgccacaaactgcaggggttgggggggttagtcaacagaaatttattctgtcctgtttctggaggctggaagtccaaggtgaagaacagggttagctccttctaagggaaaatctgttccagatccctctcctagcgtctggtggtttgctttgctgactatctttgacattccttggcttgtagccacactgcttcagtctccaccttcatctttacatgatgttgtccctgtgggtatgtgtctgtttctgtgtctaaatttctcctttttatttttttcttttttctctatctttttttttagacggagtcgcgctctgttgcccaggctggagtgcagtggctcgatctcggctcactgcaacttctgcctcctgggttcaagcgattctcctgcctcagcctcccaagtagctgggattacaggcgcccaccaccatgcctggctaatttttgtgtttttagtagagaaggggtttcgccatattggccaggctggtaacctcaggtgatccacccgctttggcctcccaaagtactgggattacaagcgtgagccaccgaacctggcctattttttcatttatttttagacagagttttgctcttcttgtccaggctagagtacaatggcgcaatctcggctaatctcaacctccgcctcccgggttcaggcgattctcctgcctcagcctcccaagtagctgggattacaggcatacgccacaatgcctggctaattctgttttgttagcagagatggggtttcaccatgttggtcaggctggtctcgaactcccgacctcaggtgatccacccacctcagcctcccaaagtgctgagattacagacacgagccactgagcctggccctctcctttttatttttaaaatatattttgtggacggcagcagtggctcacacctgtaatcccagcactttgggaggccgaggcgggtggatcacaaggtcaggaactcgagaccagcctggccaatatggtgaagccccatctctactaaaaatataaaaattagccaggcatggccgggcgcggtggctcacgcctgtaatcccagcactttgggaggccgaggcgggcggatcacgaggtcaggagatcgagaccatcctggttaatacggtgaaaccccgtctctactaaaaatacaaaaaaaaaattagctgggcgaggtggcaggtgcctgtagtcccagctactcgggaggctgaggcatgagaatggcgtgaacccgggaggcggagcttgcagtgagctgagatcgcgccactgcactccagcctgggtgacagagtgagactccatctcaaaaaaaaaaaaaaaaaatttagccaggcgtggtgtcagaagcctgtagtcgcaactacttgggaggctgaggcaggagaatcacttgaacccaggaggtggaggttgcagtgagccgagaccacatcacggcacatctaaaaaaaaaaaaagttttctgtttttgttttttgcaaaactactgaaataaatacagtgagatatttatttataaatgagaacgaattaataatgagccgtaggctgggtgtggtggctcatgcctataatcccagcattttggggggccaaggcaggtggaacacttgaggtcaagagttcgagaccaggctgaccaatatagtggaaccccatctctactaaaaatacaaaagaattagccgggcatggtgccgggcgcctgtaatctcagctatgggaggctgaggtaggagaatcgcttaaaccctggaggcggaggttgcagtgaggcgatatcacgccactgcactccagcctgggggacagagcgagactccatctctaaataaataaataaggagctgtatttcaaaatttggagaaggtgacactgagagtactgaatacacagttttttgtttttttggttttttttgagacagagtctcgctctgtcacccaggctggagtgcagtggtgcaacctcggctcactgcaatctctgcctcccggttcaagcaaatctcctgcctcagcctcccgcgtagctgggattacaggcacgcatccccatgcctggctaatttttgtatttttagtagagacgggatttcaccatattggtcaggctgatctcaaactcctgacctcgtgatctgcctgcctcggcctcccaaagtgctgggattacaggcgtgagccaccgagcctggccccaaaaaatatttatcaaaactatgttaatgctggccgggtgcggtggctcatgcctgtaatcccagcactttgggaggccgaggcaggtggaacacgaggtcaggagattgagaccatcctggctaacacggtgaaaccccgtctctactaaaaaatacaaaaaattagccgggcgcggtggtgggtgcctgtagtcccagctactcaggaggctgaagcaggagaatggcaggaaccggggaggcagaggttgtagtgagctgagatcgcgccattgcactccagcctgggcgacagagcgagaatccgtctcgaaaaaaaaaaaaaaatacacacacacacacaaaaactgtgttaatgcttaactacacaaaaatgataatcagataaatatgcatttatttagagaactgcatgttggtcagtccagtccctgcagagggaattcccagcatgacctcattcacttgtgaagacagagcaatccttgtgttttatttttttaagatggatctcactctgttgcccagactggagtgcagtggcatgatctcagccctctgccacctccaccttccgggttcaagagattctcatgcctcagcctcctgagtagctgagattacaggcttgtgcctccatgcccagctaatttttttatttttactagagatgaggtttcaccagtttgggcaggccggtctcaaactcctgacctcaagtgatccacccacctcggcctcccgaagtgctgggatgacaggtgcctggtcagcaactgttgtttagacatacacattttatctgctcgtccagcatggtcagccctccactttttaaattttattttatttatttttttgagacagagtctcactctgttgtccaggttggagtccagtggcgtgatttcggctcactgcaacctctacttcccaggttcgagcaattctcctgcctcagcttcccgagtagctgggattacaggcccgcgtccccacacctagctaatttttgtatttttagtagagacagggtttcaccatgttggccaggctggtctcgaactcctgacctcaggtgattctcctgccttggcctcccaaagtgctgagattacaggtgtgagccactgcacacggccttaaattttatttattatttatttatttatttatttagagacttagtctcactctgttgcccaggctggagtgcagtggcatggtctcggctcactgcactccacctcctgggttcacgccattctcctgcctcagcctcccgagtagctgggactacaggcgcccaccaccactcccggctaatttttgtatttttagtagagatggggtttcactgtgttagccaggatagtctcgatctcctgacctcgtgatccgcctgcctcggcctcccaaagtgctgggattacttattttgttttttgtagagacaggttctcactgtgttgcccaggctggtcttgaactcctgatctcaagtgatcttcccacctcagtctctcaaagggctgggattacaggggtgagccactgcaccccaccttccctctactttttgacggtttccttctgctatgaatgtgcatgtccagttgtctgcttcttagaactgatatttaccttcctcatccatcagccattggaggaggactgggaccgctcagattattgatctgacccattctttcggcagggtttcctggtggctgtcttccatcaccaaaactggaatcagaagagtttccatagccctttttttttccccacatctttgctgaagcagagttttgaaaaacaaaaccacaaactaagctattccccagaagaaatctgtaatcaaagataagctctgccgggcacagtggctcacgccttttggaggccaaggcgggcggatcacctgaggtcaggagttctagacctgccaggccaacatggtaaaacctcatctctactaaaaatacaaaaattagctagatgtggtggtgggtacctgtagtctcagctacctgggaggctgaggcaagagaatcgcttgaacctgggaagtagaggttgcagtgagccgagattgcaccactgcactccagcctgggcgacggagtgagacgacctcacaaaaatttacataaataaaatgaaaagtaaaataaaaatacaaaagttggccgggtgcgtttgctcacgcctgtaatcccagcactttgggagggtgaggcaggcagataatgaggtaagaagatcgagaccatcctggctaacacggtgaaaccctgtctctactaaaaatacaaaaaattagctgtgcgtggtgacacgcacctgtagtcccagctatttgggaggctgaggcaggagaatcacttgaacctgggaggtggaggttgcagtgagccgagatcgcaccactgcactccagcctgggccacagagtgagactccatcttgaaaaaaaaaaaaaatacaaaagttagccaggggtgttggtgggtgcctgtaatcccagctatttgggaggctaaggcagaagaatttcttgaacctaggaaacggaggttgcagtgagccgagatcacacctctgtactccagcctggacaacagagcgagactttgtctcaaaaaaaaaaaaaaaaaaaaaactaaataggccgggagcagtggctcatgcctataatcccagccctttgggaggccaaggcaggtggatcacttgaggtcaggagtttgagaccaggctggccaacatggtgtaaccccgtctctactaaaaacacaaaaattagccgggtctggtggcgtatgtctgtaatcccagctactcgggaggctgaggcaggagaatcacttaaacctgggaggcaggggttgcagtgagctgagatcgtgccactgcactctagccagggtgacagagtgaaactctgtctcaaaaaattaaaaaagaaattcagcaagtaatgagttaaggaattcgaatattaaggcgagtgacaaggaacgcccaggatgtggcccaggatggagtaggggggacactcatttaggagaaagctcaggccacaagacaggaggagccagccttgttggggttgaagggaagagcattccaggctgagggaactgcaaggcgtttgcatgggacactatgggatggcttctgcccttggtgggcagcctctggtctgaggccattctttggcctgcctgactgtctggcaaccgggaggaagccctgcccttcctggagacagaaacaaaggtctaggaaatatctgcttcccttttccttgaaaaacgcttaagggaacggaggactgggaggtgccgtctctctctgccagcctgccccctaccatagccatcccactcccatctcagaaagtgacccgccatcctccaaaaggctcggaccctgatcaaggagtcatcccccttgtcccagcacctccagttggcccagcctccaaaacggatgtcaaattcagccctttctccaaggacactgcccagtccaggccccactatcattcatctggactagaacagtcacctcctctcccatctcctggctgcagctcttgaagcctcaactgggcccctgtgaacacttgagttagggcaaggtccttcctctgctcagaaccctctatacctcccacctcgctgggcataaaagccaaagtcctggccaggcacggtggctcacatctgttatcccagcactttgggaggccaaggggggcggatcactagaggtcaggagttagagaccaacatggtgaaaccccatctctactaaaaatacaaaaattagctaggcgtggtgacgcacccctgtagtaccagctactcggtaggctgaggtgggagaatcgcttgaacctgggaggcagagtttgcagtgagccgagatcacaccactgtgctccagcctgggtgacagaacgagactggggttcagaaacaaacaaacaaaacaacaaagtcctcctcaggtgacaggaacttgcacctatctgccctgtcatctccctgcccgctcctctcctcgaatctctcctttgctaagcctgctccagccacactgttctcctggctgttcctttttttttttttttttttttttttttgagtctcactctcacccaggctggagtgcagtgcctctatcttggctcactgcaacctccgcctgccgggttcaagagattctcctgcatcagcctcccaagtaggtggaattacaggtgtgcaccaccacacccggctaatttttgtattttgcatagagatgggggtctccctatgttgcccaggctggtcttgaactcctgggctcaagtgatcctcccatctcggcctcccaaaatgctgggattacaggtgggagccgcgcccaggtggatttttgtctgactctgttcattcctgtgtccccagtacctggaaggacgccaagcacacagtaggcgcttaaaaaacattgagccacatgttgagaaaagaacggcaccattgtggctgcaagtgggacttgggccgcgcgggggagctcgcgcacctcgggccggggcaagagctcagtggaacccgcccgaggaagaacccgtggcgcaggattttcccaggccttctgaggaccaggggcgtcccccgtcccaccctgtgactttgctcaggccgttccggggcgggaattcagaactcctcagccccccaagaaaaaaatatccccgtggaaattccttgggaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaaccgcttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcgttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgcccggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttcttttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtaggccaggtgcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggttcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgcgggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggggctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcaggacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggtgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgaggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcatttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgcctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtggtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggtagactagacggaagtgggacagagtagaagtcaaaggtgccttagcgggtggggctgttgatcgcactttgaggggtgggagatggaggtggcagggggactgaattcaaggggagggaccctccggggctgtcactgctgcaggaaaggactttaaaacttgggctggattctgcgtggtggaaacttgacccaattcacaatccactgtggggaagattggggagggaccaaagtcattggatgttggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtg

SEQ ID NO: 1105 - DNA, 24441 bp, Homo sapiens
cccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagccttgccgcatgctcgttacttgggggcccagggaggaacacacacctgcattgtgcccagcagacccaggttgctgactgcaaactgacagcctccgattctaacacgcatgcaagttaccccaacagatacagataacgcaacatatgagctggtcctacacacacacacacacacacaatttttttttctttttttttttttgagatggaatttcactctgtcgcccaggctagagtggcgcgatctcggctcactgcaacctctgcttcctgggttcaagccattctgccttagcccccccaaatagtggggattgcaggcacccaccaccatgcccggctaatttttgtatttttagtagagacagggtttcaccatgttggtcaggctgggctcgaactcctgacctcaggtgatccacccgccttggcctccccaagtgctgggattacaggtgtgagccaccgcgcccagcattttcttttcttttttttttttgagtcggagtttcgctcttgttgccaggctgtagtgtcatggcgcgatctcggctcactgcaaccaccgcctcccaggttcaaatgattgtcctgcctcagcctcctgtgtagctgggattacaggcatgcaccaccaggttcagctaattttatatttttagtagagatggggtttctccatgttggtcaggctggtctcccaaagtgctgggattacaggcatgagccaccaccacacccagcctgaaaaaatacttttaattagctgggtgtggtggcatgcacctgtactcccagctactctggaggctgaggcaggagaatcacttcaactgggaaggtcaaggctgcagtgagctatgatggcaccactgcactccagcatgggcaagagtcagatcccatctcaataaaaaaaaaaaagggagctgtggctctgtcaattttacagcaacactggctcactcggtgcccgcctgtgccgtggctgatatgccaagccccagaaacacatcccatacacacacactccacgccgcattcagaagagcattcatgcattaaaagaacataaaagagatcggcagggcgcagtggctcatgcctgtaatcccagcacttcgggaggctgaggcagatggatcacctgaggtcaggagttcgagaccagcctggtcaacatggcaaaaccccatctttactaaaaatagaaaagttagctgggcgtggtggagtgcgcctgtaatctcagctacccaggaggctgaggcaggagaattgcttgaacctggaaggcggaggttgcagtgagccaagatcgcaccattgcactccagcctaggtgacgagcaaaacttagtctcaaaaaaaaaaaaaaaaaaacgagatcacaaaatttaaccgatattggaaatatctgggtgaacaagagggtcccaagaatatgaaaggacaaatggttctatcaagtaggaaaaaccatggatgcaccgtgggtccccatagactcaaagataacacaagattaaagtaactgggctgggcacggtggctcatgcctgtaatcccagcattttgggaggccgaggcaggtggatcacctgagatcaggagttcaagaccagcctggccaacatggcaaaaccacgtctctattaaaaatacaaaaattatctgggtgtggtggcgggtgcctgtaatcccagctactcaggaggctgagacaggaaaatcacttgaatgcgggaggtggaggttgcagtgagacgagattgcgtcactgcactccagcctgggtgatagagcaagactctatctcaaaataaataaataataacatagaagccagtcatgatggctcacacctgtaattccattactttggaaggctgagagaggaggatcagtggagcccaggagtttgagaccagcctgggcaatatagggagaccctgtctctacaaaaatgaaatagccaggcgaggtggcatgtgcctgtggtcccagctacttgggagactgaggtggaaggctgccttgagcccaggagttccaggctgcagtgagccatcattatgccactgcactccaacctgggagacagagtgagagagaccctgtctcaaacaaacaaacccaaaataggccaggcacagtgactcatgcctgtaatcccagcactttgggaggctgaaataggcggatcatttgaggtcaggagttcaaattcaagaccagcccggccaacatggcaaaaccacatctctactacaaataaaaaattagttgggtgtggtggagcattcctgtaatcacagctattcaggaggctgaggcatgagaaccgcttcaacccaggaagcagaggttgcagtgagccgagatcacgccattgcactccagcctgggcgacagagcgagactctgtctcaaaaaaatataaataaaaataaaaagatcaagagaacctaaaccattaaaaaaaagactcgcatgggtgcggtggctcctgcctgtaatcccagcactttgggaggctgaggcaggcaaatcacttgaggtcaggagtttgagaccaacctggccaacatgaggaatcccatctgtactaaaaatacaaaaattagctgggtgtggtgacacacacctgtaatccaagctacttgggaggctgaggcagaattgctggaaaccaggaggtggaggttgcagtgagcagagattgcaccactgtactccagcctgggtgacaagagtgaaactctgtctcaaaaaaaaaaaaagaaatccggaacacgcacatgtgcacacacacactggagcacttgtgcaagcagtggcttagaatgggagtcccaatcagggctcggtcacgcatttgcagtcaacacacaccacacgacacaaatacgtataaaaaaggctgacattttatttccaggttggcacgtgtataaggcacaggggcaaatggctttggggtcctggaactggaaatggagacaggtgtgtctcaggtgtccctgcctccaccaccccctaagtgcacttgagacaggaccagtggtggtggttccagcccagggtcctgaagggtcccactggctctaggggagagccatggggacagctccccaggcgggaccctctactctccagctacccaggagggaccctctcctcctagggggcgaggccagctccaaagtgcttggtggctccccaggcttaagggaccagcctgccagggagggctggggtcagagagagaatagtaagatgagaacgaggagaagcacccccactagcacggcgatggcacaccactgtcggcggtctgggaacgagaaggtcaggggtcacggggagagggtaccacctacaacctgcccccaccaggactgacccctcccctgaggggactcaccactcgtcatgtgggatactttggccaacttcctgaggaccccgtccatgcgggactgggtgtggtccatctcttgggcgaaggcatccagcatgctgccaagaacaggatggcatcagccccagatggcccagacacaccagggtggccgagagcccctggcccacccccagggtcctggcctcacatgccctgctcgtccagctcttctccaacgcggccggacatgtgcttcagaacctggatgctcccagacaccatctccagctgttgatcctgttcatccatgatcagctgcagagcgaaggggtgggagatgctgttgaaaacgaccccagaaggccaggcgctatggcttatgactgtaatcccagcactctgggaggccgagacaggcggatcacttgaggccaggagttcgagaccagcctggccaacatggtgaaaccccatctctactaaaaatataaaaattggccaggcattgtggtgggcgcctgtaatcccagctactagggaggctgaggcaggagaatcactggaacctgggaggcggaggttgcagtgagctgagatcgcgccactgcactccagcctgggcgacaaagcgaaactccatatcaacaacaacaacaacaaaaagggaccccagacctcagatcagtctgcaaggctctcccctcccaagatccaccccgctggccccaaaacctgctgtgtggcctgctgctcctcgatgtagcgagatgtggccgagactgcgctggcatccagcaggtcgctgggtgacttctgggcagctggcttgcctgcgagtatctgcaggggcacacaacataggctcagggagagaccccaactcacagcggggcctgtggggcaaatccccacggtggtaagtcaggggggcagactctggggcaggacagcctgcattccccactcaccacttactagcaaggtgacccagagaccccatcatttggcttccttgtgcctcagtttcctcatctgtaaaatgcagagagcaggatggggcatggtagctcatgcttgtaatcccagcactctgggaggtggaggtgggcagataacttgaggtcaggagctcgagaccagcctggccaacatggtgaaaccccatctctactaaaaatacaaaaattgggccgggcacagtggctcacacctgtaatcccagcactttgggaggccgaggtagatggatcacgaggtcaagagtttgagagcagcctggccaacatggtgaaatcccgtctctactaaaaatacaaaaattagccaggcttggtggcgggtgcctgtaatcccagctactagggaggctgaggcaggtcagaatcacttgaacctgggaggctgaggttgcagtgagccgagatcacaccactgcactccagcctgggtgacaggttaagaccttctctcaaaaaaaaaaaaaaaaaaaaaaattaccgggtgtggcagtgcatgcctgtaatcccagctacttgtgaggctaaggcagcagaatcgcttgaacctggggggcggtggttgcagtgagctgagatcgcaccactgcatttccagcctgggtgtcagagtgaccttgcctcaaaaaaaaaaaaaataaaataaaatgggaagagctagaatccgtgtttcctgggttgaaatgaggatttaaagaattaattgatgggggacacttacagcagtgcccaacacatagtaatgctagtaaatgtcacattttactatttgtttatttttggggggattttagctgggattacaggcacctgccaccacatccagctaatttttgtatttttactagtgatagggtttccccatgttggccaggctggtctcgaactcctgacctcaagtgatccacctgcctcagcctcccaaagtgctgggattacaggcgtgagctaccatgcctggcccaacagatgtttgtttgtttgtctgagacagagtcttgctctgtcacctaggctggagtgcagtggtgtgatctcgcctcactgcaacctccacctcccgggttcaagcaattctcctgcctcagcttcccaagtatctgagattacaggtgatcaccaccacgcctggctaatttttgtattttttgtagagacagggtttcatcatgttggccaggctggtctcgaacgcctgacctcaggtgatccacttgcctgggcctcccaaagtgctgagattttaggtgtgagccaccgtgcccggctccaacagatgtattttagagtttggacttgaattcccccaaggcagcacatctggaaggcacgtgggcactgctatgggatgacaaactgggaggagcctcagtcccccaccctccccgaccccacgtacgcttatgagggagagagaaaggctggtggttctcaacatatgaaaaatatcaacagagaacaccaagagaaaaagtggactgacagaggtggttgggagaaacacagaaacacacacacacacacacacacacacacacacacggcaggcacattacagaggaaactagcagatattaggatatgaggggggaaaatgcagatacactcagaggccaagtgcacgcacccaaataggttaggtgcatgcacagatgaaaaggcgggggcggatcacctgaggtagggagtttgagaccagcctggccaacatggggaaaccctgtctctactaaaaacacaaaaattagctgggcatggtggcacactcctgttgtcccagctacccaggaggctgaggcaggagaattgcttgaacccggaaggtggaggtttcagtgagtcaagattgcaccactgcaccccagcctgggcaacatgccaagactccatctcaaaaaaaaaaaaggaagctggccgggcgcggtggctcacgcctgtaatctcagcattttgggaggctgaagctagtggatcacaaggtcaggagatcaagaccatcctggccaacatgatgaaactccgtctctactaaaaatacaaaaattggccgggcgtggtggctcacacctgtaatcccagcactttgggaggccgaggcaggtggatcacgaggtcaagagttcaagaccagcctggccaagatgttgaagccccgtctctactagaaatacaaaatttagccacgcatggtggtgggtgcctgtaatcccagctactcgggaggctgagacagaattgcttgaacccgggaggcggaggctgcagtgagccgagatcacgtcactgcactccagcctgggcgacagagcaacactccgtctcaaaaaaaaaaaaaaaaaaaaaaattagccgggtgtggtggcatgtgcctgtattacagctactcaggaggctgaggctggagaatcgttgagcccaggaggcggaggttgcagtgagccgagactgcgccactgcactccagcctggcaacagagtgagactgcatctcaaaaaaaaaaaaaaaaaaaaaaaaaaggaagttatgtgcgatggctcacgcctgtaatcccagcactttggaaggctgaggcaggcagatcagttgatgtgaggggtttgagaccagactgaccaacatgacaaaaccctattaaaaatacaaaaattaggccaggcgcagtggctcatgcctgtaattccagcactttgggaggctgaggcaggtggatcacctgaggttgggagttcaagatcagcctgaccaacatggagaaaccccgtctctactaaaaatacaaaattagccaggcatggtggcgtatgcctataatcccagctactcgggaggctgaggcaggagaattgtttgaacccaggaggcggagattgcggtgagccgagattgcaccattgcactccagcctgggcaacaagagtgaaactccatctcaaaaaaaaaaaaaaaaaaatacagaagttaccctggcatggtgacgagcacctgtaatcccagctacttgggaggctgaggcaggagaatcgcttgaacccaggaggcagaggttgcagtgagctgagatcaagccactgcactccagcctgggcaacagaacaagactctgtctcaaagaaaaaaaaaagagtaaaaggcaggcatgcgtcctggaaacaggtgcacacaggacaaatggcatggaagcagaaaggagataggtacacaggcccccagccctctcctgcaacaggaaaccagtatagacccagaggacacagtagagaggaacccacggacatatacacatagagaggttcaggtgcacacaccgagaaagtgcaggcaggtagacagcaagaagataactgcccacagagaggacgggcactgtcgcaaaagggacaggtgaacacgcacagagggatctggcttggttacccccaggggctcaggtgggcagggtgggtcaggaaggcttacctctctgttattcctctccaaaaatgctacggctgttgggctgaccatatggtccttcatttcctggaggtaaggacagcattagggaggaaagacactcaggctgggcgcggtggctcacgcctgtaatcctagcactttgagagaccaagccgggtggatcacctgaggtcaggagttcgagaccagcctgatcaacatggtgaaaccccgtctctactaaaaacacaaaacttagccgggtatcgtggcaggcacctgtagtcccagctactcaggagactgagacacaagaatcgcttgagcctgggaggcggaggttgcagtgagccgagattgcaacactgtactccagcctgggcgacagagcgaggctctgtctcaaaaaaaaaaaaaaaaaagaaagaaagaaagaaaaaaaaacacactcaaaccttcccccactccccgcctgcaggacctttcctgacctggactgcctctcgcatccgctccacgaacacctttctctcctgcaggtccccggctgggagcttgaacttgcctgggttggcttccactatacgtgggctgagagtcaagggtcaaggccggagccagatatcatccccgtccctaggggtccagccctacccgaaggtgggctgccaccgcaatgggctctcccatgccaccctctgccacaaagccccaggatatcgatggtctcttccaggtcctcgaggtcccactcgatgctgcgcaggccattccgcagctcattggtcgtccagtccagctcctcgcgtccgaccgccgcgctttcctgcaggagctcgcaccagcgctggtacagcccgcgggccgtgttcaccgccttctgcacctcgctgcgggcaggggcacggcgggcgcggctgggggcaggcggtcctcccgcctgcctctgcccccgactgcaaacccaaacgcatgggggactccggagacccctatatacccctgcgtgcgcctcccactctgcaccccgacggccttgcccagcccgccgggcacgctggggccggcacccgggcactggctggcttgggtacagagcaccctccgccctcccccgtcgttgtcactcaccctcggactacaaaaaaggggtcttcgagagacatgtcagtcccttcccccccaggccgaacccccctcccggcctgggttcgcgggctggttccctcccaaccgaggagaacgcgccgccacccccgcccccgtcacgccaccatcgagagccggaccgccaggggagaaagagaagcctcggaggcccgacgtgcggacacttccgccctctcctcagccatcttggttgtgggcagaggcagcttccggtgcacatgcccccgccccttagccctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgccgcattctcccaatctctttcctgagaagtggcggagttgggggcacttcgaggtcgccttggggcgaggtggtcgtgagggggtcccagatatgccagcagcggggggaggtcacctttgagaaagtgcgtggaggtgggtttcttcagaagcgcggagtctttctgggtgcgagcctgggggtagcgggtggtggctttgaggatggtctccaggggggccctctgtgtgtggggtctccgtctgggtaggggccaggaatatcagcggagggactcagggtcgtccctatgtgtgacagtggcgctgtgtgttggggagcttcgggaaagcactttttttgagtgatagggggcctggtctcccctggagggtgggcgggttatctgagggagtcctcggagggtcgcccccttgcgcgtcagagttgctgcgtggggtctcagagatagcgcctgggctggggaaatcattgtggggtctccgtggtaaggttagcggggtggggacggcctgcgtcttcggcaggtcgtcgcagtctggcaccatcgttgaatggggacgagtttgggaagggtattttaggggggaataacttttgagttcccagcgtgcgggggaagggcgggacgggagggtgtcccaaggcctgagaagatcagtgtggggcaggggtcaggaataacctgggagggggccttgtatgggggaaataattgggaagaggagagatgggatgaagggggcctcagcgggtcgtctcctgtgtatgcagggtcgttctgcagcgtctctgggagatggcgtccctgggagccctcaggtcgcccctacccgctgcggggtgctttcctggcgtcacgccttcctggcccctggagggaaggaagtgaaactctcctcttcccccacccggctggaatgcgagtcaggaagcctggggctccagcctgctccggctgcccgggtcggggatggggaggggcgtggccggagcgcaaagccccgcccctccgcgccccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgctgtctggttttctgctgtggtgggggaggggcggggttaaagcgtcaggggctggcagccgctcgctggggccccaagaaccggtctgaccggttaccacgtgggcgagagagggttgggcccccttttccttgcccgggcattccctaactggtggagccccgcctcccccagatttgggggttcccttgaaattgtcctacaactccgggacagggagatcggggctttctgagttgagacaatagtgctaaacacactgccccaagcggagctggggatcgattgcacgcactttgaagccttgaaaggtggtagatctcgcccccaccccctagaccaaactgaatcagctgtggccggggccctacagtatcaggtggagctgagcgggtgagctttgaagggctctttagtccccagttcccgtatcttcctcgaggaatcgttgtgtgtctcaggcagggacgtgcagcctcagtttcctcatctgtgaaatgggcctctaagcagcttctccacccggcattaggtttttaaaaatgcccattagagccctagttattttcttgggtcactccccagctctagaataaccaccccgaaacgagaaagccctttcaatataccccacgtaggtttaagagtggggttgtgggcgttgccccagggcgaagggagggggcctgtcgggaagacaaaggagtcgcaggtgcggggagtggtggcggcggcaggcgccgggaaagcgctcgccccgccccgccgacggctggctctgccgccgcaggcttcccatgaccccaggggaactgaccccgtggccacagggtagaaggaggggcaagccggcctcagaacgtctgctggtggaatctgggagctttggctcccctcccgcccaacccacaccccctttcctctcctgtgtggattgtgaaggagagcttctcaccgttctccagccaagctcgcccccacggctgcctgattccttcctgggaacacgtggggggacttttaaaaggcgccacctactccgagtcctgacccacccaactctcccaggggacgtgggggcactggagccccacaccgcaggcggtagctcaatgcacccgcgtcggagttcctcccccgcgagcgtggcaaggctcagggaagtcccgggcccctggggagggggccttgccgcgcatcctgtcgcaggaaccgccgggcccttccttccgcgggaagcggcttggccgacccccgcccccgcccgggcctcttgggggtttccggtgcccggccaccgtggggctggggactgaaagtgatgggactgaagatggggctggaacaaacacactacagacacatccccttaagacacacccatccccaagaccccactggacccatcagaaaaggcagcattgaaccttgtcacagcaaataacattggtgaggcctggactaattgattggacaatggctgtgaaaactaaaaaggtcacccatcctgtgaccagcaggttccagcagggaaccccaagcctgctgcaggagactccagaaaggtgtttgctgctggcttgtactaaattggcacaaactgcaaacagcacagcctacatgcccatcctcccagatgggtcctccccagaggataaaaggccggagccagacagaactacacacacaggccacacagataattcggtaccagaaacatgatgctgagtgacaaaggccagctgcagaagtcaggtaagaagcacatattctgggccgggcatggtggctcatgcctgtaatcccagcactttggaaggctgaggtgggcagctcacctgaggtcaggagttcgagaccagcctgatcaacatggtgaaaccccatctctactaaaaatacaaaaattagctaggcaaggtggcaggcgcctgtaatcccagctatccgaaggctgaggcaggagaatcacttgaactcaggaggcagaggttgcagtgagccgagatggtgtcactgcactccagcctgggctacagaggaagactctgtctcaaaaaaagaagaagaagaagaagaagaagaacatattctggagggagggaaacaaccaggtctactttcgttttcttgctatgcatccttgagtgagtcacttgacctctctgggcctgtttccccaaccgtatactggggacaataatagtccctgccttttaggtttgttgtaaggattgagattacacatgtaatccttacaacaaacctagcagagtgctggcacgtagaaaatgctaaatgtgctgggtgccatggttcatgcctgtaaccccaaaaatttaggaggctgaggtgggaggatcacttgaggccaagagttttcagtgcaatcatggctcagtgtagccatgtagcctcgaactcccagactcaagcaatcctcctacctcagcctcccaagcaggttggaccacaggctcaggcaccatgcacagctaatttcttttttttttctttctttctctttttctttcttttctttcttccttccttctttcctttttctttctttcttttctttccctccctccttcccttcctttcttcctttctttcctttctttctttcaactagagtctctctatcacccaggctggagtgcagtggcttgattacagttcactgcagcctcgagctcctgggctcaggcaatcctcccacctcagcctctggagtagctgggactacgccaccacacccagctaatttttcttttttttcttcttctctctcttttcttccttgtctctttcttttcttttcttttttgtttttgacagagtctcgctctgttgccaggctggaatacagtggtgcaatctcggctcactgcaaccctggcctcccggattcaagcagttcccctgcctcagcctccgaagtagctgggactacaggcgcacaccacgacacctggctaattttttttttcccaccggttgtcaaatgaccctttattgaaatatttttctttgtgcttcttaactagctgggcatttcacagcaccactgtgggtttttctggttttttggggtttttttttttgagtcggagtcttgctctgtcgctcaggctggagttcagtggcgcgatctcggctcactgcaagttccacctcccaggttcacgccattctcctgcctcagcctcctgagtagctgggactacaggcgcctgccaccacgcccggctaatttttttgtattgtatttttagtagagacggggtttcaccttgttagcaaggatggtcttgatctcctgacctcgtgatctgcctgcctcggcctcccaaagggctgggattacaggcgtgagccaccgcgcccagccatcaccactgttgatgtcatctatgatgtcacgagggtggcggccatcaacattacggcctacagactgggcagtccccaggatctctttgatggttccagagagttctctggctaaagatcggtgccacatctgtcgagtaatgttgacgatctcatcaaaagtgatattcccattgtgtctaatgtttttctgtttctttctgtctcttggtggttccttgagggctttaatgatcagggcagaggcagaaggcaccacctcaatctgggcctgtctgttctgaatggtcagtttcactgtaatcctcaggcccttccagtcaccccattgccttggcaaggtcattaccaagcttttttggagacagacccagggggccgatcttgggggctagtgcagaagtggcacccccttcaccccgagtgcacctcaggtatacaaatttgatctcgttggggttgaactttggcagcatggtggaggtgattggttttggaaaaacctggattctggacaaccgaagaaagctgcaccttgggctcctccaagccgaaagcccagctaattttttttttctttttgacacgaagtcttgctctgtcaaccaggctgcagtgcagtggtgcaatcttggctcactgcaacctccacctcctgggttcaagcaattctcctgcctcagcttcctgagtagctaggattacaggcacccgccaccatgcctggctaatttttgtatttttagtaaagacgaggtttcaccatgttggccaggctagtttcaaactcctgacctcaggtgatccacccacctcggcctcccaaagtgctgggattacaggaatgagccaccgcacctggccgaaattttttgtattttagtagagacggggttttaccatgttggccaagatggtctccatctcgacctcgtgatccgcccgcctcagcctcccaaagtgttgggattataggcatgagccaccgcgcctggctctttcttttctaacagggtcttgctctattgcctaggctggagtgcagtggcacgatcttggctcactgcaatatcttcctaacaggttcacgagattctcccacctcagcctcctgagtagctgggattgcaggtgcacaccactgcgcctggctaatttttatattttttgcagacacagggtttcaccatgttgcccaggctggtctggaactcctgagctcaagtgatctgcctgcctcagcctcccaaagtgctgggattacaggcgtgagccactgcacctggacgtatttattttttacttaggatttgtgccctaactcagaagttaattctgttaattctaccaatgtccagcctgagcctgaatgagtgaatgaggttgttttgggtaaacaggtgttacatgcttaatgtttatcatctcattaaatcagtggcttctacatgactcttagaatttctcaaacctcagatggttgaggggtcaggatatttgtgatattttcataactactgtactattattattatcatttatagacagggtcttgctatgttgcccaggctggagaacagcagcgccatcatagctcactgcagcctccactgcctaggctcaagcagtcctcccacctcagcctctgcaggagctgggaccgcaggcctgtgacaccatgcccagctaactgtattcatgtaatagttttctttgcgttaacccacttattaatcactctccctatttagaaagtaacagttttttaaaaggttacaatgaaaataaaacaatgtcaaaagatcctgctgaaacagtaacaggtttaatagtttcaaagagagattagccagccttaacgacacattgtttccaagggaagaaaactatgcttgggctgagaagggggatgcaagttgacaagggagaaatttggagagatccagtccacgttatttaaataacattgaattgggctgggcgaagtggctcacgcctgtaatctcagcactttgggaggccgaggtgggcggatcacctgaggtcaggagtttgaggccagcctagccaacatggtgaaacatcacctctaataaaaatccaaaaattagccgggcatggtggtgagtgcctgtagtcccagcgacttgggaggctgaggcaggagaattgcttgagcccgggaggcagaggatgcagtgagtcaagatcacaccacggcactccagcctgggcaacagagtgagactgtctcaaaaaaataaataaataaataaataaccttgaattattttgccacactgtcccagaatatggaaaattctgcttctggaagagggacaaactcctatgatgatctgcaaggccctgcttgatctggggccatcccatctctggatgaatcatgcatcaccctctggccacatggacctgctttttgttcctcatacttccacagccttctcagccacatggcctttggatatgccgtgacctcctgaagatctttcagcttccttgctcacctagtgaagccagctcagctcaaggggcaaatcctcagggaagtgttccctgtctaaccctcttttggcctaaggactgctttattttattttttatttttattttttgagatggagtctctctctgtcacccaggctggagtgcagtggtgcgatctcagctcactgcaacctccacctcccgggttcaagtgattctcctgcctcagcctcccgagtagctgggattacaagctcccaccatcacacctagctaatttttgtatttttagtagaaatggggtttcaccatgttgtccaggatggtctcgatctcctgatccgcccgcctcagcctcccaaagtgctgagattacaagcatgagccaccgtacctggcctattttattttattttaattaattaatctatttttgagacagggtcttgctttgtcgcccagactggagtgtagtggcatgatccaaggctcactgcagcctcaaagtctagtgcttaagggatcctcccatctcagcttccagcatagctgagaccccaggcacacaccacgatgcctggctaattttttattttttttgtagagatggaatttccatgttgcccaggctggtgttttttatttatttatttaaccagtctctgatgggaggcaagacccctatatttgacactcggatcaagagctactttatttaaaacatttggccaggcatggtggctcacgcctgtaatgccaacactttgggagaccgaggcaggaggatcacgaggtcaggagttcaagaccaacttggccaataaggtgaaaccccatctctactaaaaatacaaaaattagccaggcatggtaacacgcgcctgtagtcccagctactccagaggctgaggcaggagaatcgctggaaccttggaggagaaggtttcagtgagccgagatggcaccactgcactccagctgggcgacagagtaagactctgtctcaagaaaaataaagagaccaggcgcagtggctcacacctgtaatcccagcactttgggaagccaaggtgggcggatcacaagttcaggagctcgagaccagcctggccaatatggtgaaacctcatctctactaaaaatacaaaaattagccgggcgtggtggcaggagcctgtatcccacctcttgggaggctgaggcaggagaatcgcttgaacccgggaggcggaggttgcagtgagccaaggtcaagccacttcactttagcctgggcgacagagcaagacttcatctcaaaaaataataataaaataaatttttgcggggctgggagtggtggttcatgcctgtaatcccagcatttttggaggctgaggtgggcggatcacttgaggtcaggagtttgagaccagcctggccaacatagtgaaaccccatctctactaaaaatacaaaaattagccaggcgtggtggcgcgcacctgtagttccagctgctcggaagggtgagatgggagaatcgtttgaacccggggccggggggctgaggttgcagtgagctgagatagcgccaatgcactccagcctgggtgacagtgagactcagtctcaaaaaaaaaaaaatttttttttgttaatacttatcacaagtgcaattttacctttgtagaattaaaccgttgtttctgagttagtttcctcttgtagcctactgcctccaagtctagcagatggttaagcggtttttgtgaatgaatgatgcctttgcaaccttcgtttgagatctgtcctcttaacgtccactgtgtatatatgaggaaacaggcccacagagtttcgctctgcaagacagcaagtaaaggacagctctagtcgggtcctctatcccgaagcctcctccccactctgccctgccctgccgtgcaggacccaaaggaagggcgccccagttcagcctctgtagatctgggaaagggccgggccacaggtcgggaccaatccagaagcagcacccagaccggtttacccggttccaggaccttgggcgaagtccacccgcccgagggcagggacgacgcaggccacgccgcggcccagttgctagccaggcagggtggggatttgatcttgccaaggaaatgtgagcgggaggccgagcgttggaggtgggtaagtcgtcactatgcagggcggagccatcctgtgtctatcacgcccaagggcggtgcatgcaaattgactcccgcatttggcttttccccgggctccgtctccgcgcgctgcaacccgcgacttccaagaactccccgcgtagtcagctgcccgggccacgccccctttccggacccgccctgcccgccccagggaggcgggggcggagcttgcggcccagcgggaaggcggaggcgggggtcgcgcccaggtcccgggggcgtcagaggcaatgggaagtcgtggcttctgcaccgcccttgggggttcggctcccaatcagggaaaaagggccgagagaatgaaagagtaatgagacttgcgagtttgaggctcacactactctctttgggttgggggttgctgaagcctccacgtgtattcagggagccccgaacctcacacctctgtccaggggagctcagaacccgccgtgttctggaaagcctacaccttccccggttttttagtgtctaggggagcccacaaccctcacagccgtgtctagtagcgctcagatccacacacctgtgtttgggggagcccagatcttctctacctgtgtccagatgagttcagagccccgacgtttgtccaggaaagcccacctctgtccagaagcgctctgaccaggacctttcctgtttcctgaggctcagcctagggggtcatcccacccaggtctgtgttaaggggagcttgtgtctccccaaacatgtccaagtgagctgagctcaggagctgaggcctccccatatcgtgctccccgcctggccctttggtgaatccctttctcagaagaaaccctcaggggccctagccctgctgcccttccctgcactgtcttcgagcctcctggcccaattggcccctcccccagtacactgttgagtcttagttaagacataatcccagcattcactgtcccccatcccccagctctcccgcacctcggcggctggccgggcccccgggagtgccgtcatcccagccggctggccacccgactggcaccaattaatttcctcctcggcctgtccacccagggcctcggcctgtctggttgccagctgctcaccctcagccagcccgccccctcgggctcccagggaattgccaacagttctcctccttcctgcaacccccccacccccaatccaggccaccccacccagcacagttaatcagaaaaagctgacagttaggacctggaggagtgatctgaaatcagatggaggaggggtgggatgttaaactttcggacccagggatgcttggggtggagcgggggcatggctggagggaggcagaggatccagttttacttaagaaccccaaatcaaaggcttgtagcttccagatggggactgcagggagggctgaccccctcccgcatacaccaggcgggcaaggtggagcgcccctcctcggaaattgccccccgcccaagatgcgtcagtgacagctgtgcctcctcagcccgcacccagccggtttccttttcctgtgcacactctcccgatgggctggccttcagcctggagagactccacggccccttggaaggggctccccagagggtcttcctggacgagggggaggggacaggctgaagaacaatggggcttctgtggctgcaggacgccaggcacttcctgttaaccctttcctcggggtgcagctgcagggagcacctcccaggtcccgccttgtgggaaggggcagaggcagcctgaggggaaatcttgttgcgggaattaactgttgtgttaattgaggcttttgtgagtgtacttaggaggggtgaggtgaatcacaccttttctcacttgatggagttacagggctttctcctctattgctgagggctgtgcagt

SEQ ID NO: 1106 - DNA, 43444 bp, Homo sapiens
agtgagagactcagactcctgtcaccatggggattgggatgccagctgccaggccggggagggtgcagctcttctccctgcctccgacgggtcagttgctggctccacttgcccagctgcccaccggcctcacttggagtccaggttgggaggaggctcttggagaagggaagtggcttaaaccaagcatctttgctttgatcggacattgacatcacctggagctcttcctgggcccgcccccaaattgccatgtggtaggtcaggtttacagctctaacaagcctcaggtgaggctcataatctgtgagccacactcccaccatcattgatttcaaccactggccgagttgtcttcatggtttcgaagtatctcagggaatgaagagtcaggcatggagaaatgccgttggaaagattctgaaaagccatctagaacaccattgtaaatacattggagaaaatgaagtttaagtaaaccactcaggagcccttctccctcctctatccaccttctgttcatatgcattttaacagtcactgtgcatatgcaatattttccctgtaacatactttttttttttttttttttgagacggagtctcgctcttgtctcccaggctggagtgcagtggcgtgatctcagctcactgcaacctccgcctgccgtgttcaagcaattctcctgcctcagcctcctgagtagctgggattacaggtgcctgccaccatgcctggctaatttttgtatttttagtagagatggggtttaccatgttggccaggctggtcttgaactcctaacctcagatgatccccccacctcgacctcccaaagtgctgggattacaggcatgagccaccacacctggctgggcattgggatttttataaagctaccctggtggttctaatggcagtctgggctgacctaaagtgtggatgtgtgaagccaggagatgggaacagggctctgctgatggcttaggggtctcacctctccacccccttcacccaggcaccttgaccctctaaatattagtttagtattaaaagctatttgtgtacatgccctctaaatgtaagctggctaactccatttggagctcagaagaaaaagtctcgatcacttctcatgggaaacaggctgtctgctgcacctttgggtaactaaagtgatttgcaggagtagttagcttatgcataaaacagagaccttggagtgggaatgcctggcttccatctcagctgtgcttcttaccagctgtgtgaccttgggcaagttgcttagcccatctgtgcttcagttttatcatctgtaaaccagggataataatggcatctaattcacaaagtggttgtgaggattaaatgactatatttgttagaaactgaactagcagtgtgtcttgcacacacagtgcctggcacacactgattttgattgcaacatgaggttttacacctgacgctatgactaagcttcagtatgctgggtcccccccactggatgggacctctttgaggctggggactgagtcttttcatcttcgggtgtcctgaatggccttgctaatcagaggggtccctgggcgggcagcatcagcatcacgttggagctcgctagcgatgcagaatttccagctctccagggacctactgcatgggaatctgcattttatcaaggtttcctggcgcatatttgaagttgcgaagctccacccggcagcgcatgggtagctgcaaggggtggctgctcagtggacgccgggttgagggacagaaggaaagttgctggctgcgggctcctccatgctcttctcctctctccccagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtgtgtgtcttttgcctgagtctttggggtcttccagggagagatgcagagcctggcctaggttggcctacccgccatcatccagctttgcccctggctcctaggaaaatgggaaaggccgtttccgtttcccattcatgaaatggcaataagaaggaatgggaacctcctgaatccagatcaaaccctccagtgcagccccaggactcccaggtgaggcttctgcccccatgtggcccctgcctggcgctgtacaggggcaggatgagtcacgggctggggatggggagatgtggagcgtgggtccggcttcctccctcgcacattcagataacactgcagtgggagataaggaacaggaaacgttgggattggggttgtctggcccctgaaataaaggaggctccctcctgcccagggtgagacatttccactcagcccccaaagaaagggagtagggctgtggttaactggcttattcataaggatgacaccactgagaattcagatgctgctctctaaggggcccaagggatttggtgtccagaccagcaaatatcaattgaaacaaagggctatgagtgtgtcaaggtgtgcaggctgagggactgtggaaggaggcacagaatgtggcctttcttagcagagttccacatcagagctcacctacatctgccattctgttctgctggcctctcaactccagtgaattccagggggcttatgcaccccgacccctgcctttgcaatgggccatggggggagaaagctcaccatttgaggcccacagtccctgcccccctaaccttcctcggtacgtggcccagggcctggcctctcctgtcactcccctctcctgtggctggagtctgatcccttcccacagaggaggggctccctaggggcctggcccaatccactaccttccagaccttccatctggtgagtgtagggaggcggagggatggcgggccctttaccaggtgtgacataagtgtagctggaatgcaagacagcttttggaaatggcacaagatgagctttcttggagtgcaggaaaaccagatccccaagaatagatggagccatgccaggagggtgtgttctaggctgcaccgggccaaggccagcacttggccacagccccaaaagtattcattcagcggatccttgtgcatccgtgaaacaggcactattgttagttacactttacagatgaggaaaagtgtaactagaagtgcccaaactctcctgccctgggtctggggacccctaactccagcgtgtggcagccacccacccctgagttatactggccccgtggatggaagcaggtgagacgcttggagagggcctagagggctctgggcactggatggacctggagcttgaagctcagcagtccctgcatggggtctgattgtctttcattcggcgcatgcgtgctgcagctggcccttccccctgccctctgagttgctgcaaagagcagtcagccccggggctgctgtccccaggtggagctgctatccctgggtggagcagcccgtgcctgccctcctgggaagcctggtgtttctcaacctcggtgaacatttgactcgacggcggcacttaaaacaaaaactgatgccagtacctcagcttcagacattctgatgtaactggtttgccatggagcccaggcagggtctttttcctttcttaggttccatggtgattgtgaaccagggagggataaggcaagaaaaaggccggagtcaggacacctgggcttggatcctttcccaccacttcgttttccattgcctggggctatgctgtccaccttctctgagcctgttttcctcatctgtctattggggatgttatcagcctcaaatagcagggtggtattagtgtgagactagatgtgaaggtgctttgaaaactaggactgtataaaacgggaggggttactatggggccattgttgggtcaggtgtttgccagacctcacgccccagggctgccaccttgtccattctttgaacttttccagagggcttctgaggatgccacaatctccttgcccatttcccctccattacccttagtgctcttgtacccaaccctctgaagaggtagcttttatgggtgagtgggtgagcagcacctccgctgtggctctagctgcaggaaccacactcactgatgtgcagtgcaacctagaaacctttgccgagaggaagcatcattgcatccacgtgggaagatggctggctgggcagggatcttgaagatgtcaagcacatctctcacctggaactaactgtgcctctttgaacgttaagcaaacaccggggctatactgccactgtgtggcagcatgcagaactgcagctgagcctacatcgggcccttggagagtctgttgcattgaagaggagtggtccagaaggagtcagctggagacgttgttaccactggccctatcccagatcccctgagttagaagctcggggaggggcctgggagtctgcattgaaacttgcttcctgtgtggttcttatggaggactggttgacttcatttataggatccagggcaaaataaaaatatggagtcccttattcagaaattattaagaatgtcaagacagaaatagcagaacattaaactaagtgtcagccttgtatgactgcatgggtcatgcccacggggctatccctcttcttatgctctctacatttggacagtcaccactgtcatccctgaatctgtttgatgtgtcttgaatactaactacataataagatgtggtggttaaaagcgtaaccatggaggtgaggtagtctttgaacagaatcagactcttgagttatgtgcctttggacatatttctaacctctgtgaatctcatttacttcctctttaaatattgggatagtttctatcttaaaagacttgctttgagaatataaaatcatttctgtcacacggtaagtgctgcctaaatgtagctctcggccttgcatggtggcttacgcctgtaatcctggcactttgggaggccaaggcgggtggatcaaccgaggtcaggagttcaagaccagcctggccaacgtggtgaaaccccgtctctactaaaaaatacaaaaattagccggactcggtggcgggtgcctgtaatcccagctacttgggaggctgaggcaggagaatcacttgaacctgggaggtggaggttgcagtgagctgagattgcacgagcctgggcaacagagtgagactccgtcataaaaaaaagaaaaaaaaaatagctctcactatatcccaggctcggtattaggatgtcaggctatgaagatgatgaagatgaagaagattacagcctttgtcctgaagggctgagattcttgtggaaggaaacagccccgacacccaaagatggccctccatggatggcggtacccctccagtaggggatgttgggcaagttaggagaaatagttaagtctggtgtcagggaaggtgtctcagagagggtgaaggcagagttggaaggaagaagctgagattggggagaggagcgggaggatgtacgtgcctcatgcatgcatgtatgtgcaggtgcgggtgttgggggctggggttcagacagagggagcagcatgcgcagagactttatcttatttttatgtctgtatttatttatttttagagacagtgtcttactctgttgcccaggctagagtgcagtggcatgatcatagctcactgcagctttgagctcctgggatcaagcaatcctcccacctacctcatcctcccaagtagctaggactacaggtgtgcaccaccatgcctggctaatttttattttgtagagacagcgatctcactatgttgcccaggctggtcttgaactcctggactcaagtgatcctcccactttggcctcctaaaatgctgggattacaggagtgcatcaccatgcctggccggcaaaacctttaagtcacgagctggacaatgagcctggacaccggcgcatggttggggatacatgtggtgaagggaggcggcaggtggaagaggaacgagaggaagaggaagccagggcacatcaggaacgacttggggtgtgttgctgagggatttgaactctggaccaaaagttaagtaccaaggaaagaagttaggcagaggatgggcatgattggtttggtgtttagaaagtgaactgggccaggcacagtgggtcatgcctataatcccagcactttgggaggccaagacgggtggatcacctgaggtcaggagttcaagaccagcctgaccaacatggtggaaccccatctctactaaaattacaaaattagctgggcatgggggcgctcgcctgtaatcccagctactctggaggctgaggcaggagaattgcttgaacccgggaagcggaagttgctgtgaactgagattgcaccatggcatcccagcgcaaaactccatctcaaaaacaaaacaaaacaaaacaaaaaaacatgaactgcaactgtgatgtccagcgtggaggacaatacatggtgtgggattgggtggaacatccctgcagcaggaattgcaaggatccagggtagaagtgagcatgatctgaatgaaccagggctggggagatggagagaagggccgagggtgagggtggtccatgaggtcactgattcctagcacctggtggcttattggatggaaggggtaaatgaagagtcaggactgaggccgggggttgggcttggacagctgggtggatgcagtgccattctctgagacagcaaacaggaggaggaggaggaatggggaataagaggagggggctaaagaaggattaagagaaggaagagggatggcttagtggggaagatgatgagttcaaattgtgttgttattgaacttgtactttgtaaagcattagataaaatcataagagaggccaagagcctgagcttacaggatgagttcaacgtggaacacattgtatttgagttgcttgagggacactgggtggagaagacatccctgactttccctcattctcatcctgatgtcaattcttgagcaaggtccatcagttctgtctgcaggccgcggttcctctctattccgtcctccccatttcctctgtcaccaacacagagggagatgggatggttgatgcgtggggggccgacaagcaggtggggagcgtgcaggaaggggctgttttgggaacagaggaggactggcaggggaggagacaagagtgtggcgggcggttttgtggatagctttgtaggggttgggatggggagatgggaaggttctcacctgctggccttggttttctctgatagggagaaggtaagggtgtttgctaggagtgagggaaggtggtaccatgcattggagaaatgagggtaatgtgggggaaataatccgattaggggcccctaataagtttcccaggcaggatgtggggccctcggagcctggggattctggtgtgatgtcagctcactcaatagtggcacttttccctgtggggctcagcagtgccatgcaggagggacagtgctgactggacagggctgaggtgctgcagggcaggggagccccagacaagctgatgccaagcatggagctatgggcttcggtctccttaggcaaagcatcagagccagagagggctgatggattgaaaactcaagcggggtgagcaaaggctctctgtcgtaaaatcgtctctgctctcttgcctcattcttctcactctcatagtagactacgattagagtgggagagtggggttttcagattttagatgtggaatcttgggggtcccatggctcagagtgtggcttaagtggatggaggggaaggcagatggtgtgtggcagagcttggaccagcagcataccactggggagagggtgggagacacagtttctgggctgctgaaccgcggggaccccaggggaatggtgctatcgctaaggggctgtatgggttgtcccactgagcacgggcagtacagggtggtggggagacaggagtggagtagtccgtccagagccggaatcatcggtggtcacgggctgtgagcagggattcacagatgtgggttatatgggtcggaggagatgaaaggggaggaaaggaccacagtggtgggggatacagttgtgtggggggcgggcgtgagagcctctggggaggagcactggggagaaggatcccagctggcacctgctccaggcagtgtgcctgcaatggtagggtgagcagcttcccccggataagccaggagacactctgggggcaggaggtgccacgtgggaggccttcccgtagttccttttcctgtcccccgacttgaggcacctctggaaaggaaagcagagaaggtgccttttccctctgtgcacctcctaatgcatcctccacctcctcctcctctacctccactgctgggccccggtagcctgagagagccatgtgggagcctccctggctacccaggtgactgcagggcaggctgagtgacaggcatccgaatcctgtgctctttggctggatagattactctgtgaacttgagggacctggtgctcacaggtgtcagggaagcggctcagccaccccagaaggaggtgtgcctggtgacgaatcaggccatcggcaaggcagggacgccccagtgactcctcttgccccgtgactaggacaggacgggacacatggcttcctggtggcctcagccattgagctgagcagagtgaggatgccaccgcttctgtctccctgctctgctcctgggcctgagactctggggtgtgcggtcagtggggtgcctaaggggcagtgtgctgtgcagctctgtgaaacacaggaggggccgtaggggaagagcctggggacgaaggggcctaggagggaggaaagcaacacagtgaggcggcagaaggtcggagggtgtaagaactgtgctcttcagtgcccaggggttgacatcaggggtgccatcttgggttttcctcttcactgggcacagacagcggtggaggttgggtaggaaccagagggagactttatcttggccagaggttcccaggagttatgagcttacaaggcagtgggaggagggaataaggaacattctagaaatggcttccttaaaatcttctccaaggagcagaaacttctcatttgtctaagggtggatgaaggccactttacttcatagcaagggctgagatgaaaagatggtaataatcattaatagaacagtaggggaacaggtgctgaatattcccagttctcagggctttggggacattaactggttgaatcctcacagcagctccatgaggttttacccacaaggaaatggaggcctgaggaggttatgtaggttgccttgggttccacgactgtggtggctttccaacagatggggaaggggccgctggagctccagtgggagtgcttgtcttgggggatgaggggttctctctggaccatgtggccgctcagccctgatcccaccgggggcctttctccatcccctctcggctgtggcctgaggagaatcagggacttgcctctccctctgcctgccttccctgagccctcggaggaagccgacgcaggctaactgaatgcataactttattaaataaatgctttgtcatgacaaaagacaaagatcaaggagtaacataaattataagttgaataaatagtatacagcaatcttcactttttaagaaaatgtgagatcctttgttggttttttatttccttaagtacaaaatgctaaacgggagccgagctcttccgcattcaggtgttttttttttttttttcggcttttttttttttttctcacaaactggttgcatttgttgatttatttttccatccttttcaccagtaaagattatcatcgtttatttttgtttttaaagttgaaaacaaaaaagaggagagaacagagttatggtatgaatgtatgtaaaactatagagaactacagtaatatgtactgtggttattgctgtcttcaaaaaaaaaaagaaaaagaaaaacaacaacaacaacaacgaaaacaaccggtaggcaactcggaatctgaaggaatcttgtctgacaactgtgctatccatgtgggctacggtgtgacagtggcggtagagaggagactccggctggcgaccggggactggtggagtggggtgagcgggcacagggaagctggggtccccttcccctcggaccctccccaccttccctttccccatccaaaaggatttcaggagaggaggccagagtctgtgaaatgactaaactatatactccattagaaaaccaagaaagtatgtttgaaatagaaacaaaagcctaagagaaaataaaaagtggagaaacagtgcaatgtaattcttgcactttagtggttttaaaaacacagacagtacaaggcccaggttgctggctggtgaaacccctgtccctcgtccctcctccactttgcaaaacggagcctcctttctcttggaagccagacatatcctctctgacgctatggggtttcttctccttagagctcttctctgaggttcccattctgggccggagccctctcaggagtgagtggatgggtccggggtactgtcccaccttgaggggggcttggcggttgccgtggcagccctgtctcactaaccggtgcgtggcgggagcaggtggttgaggcccaccctctaggggaggccagccctgtgggggtaccatggaggccacagaggtggtggtggggagatggggtgggagagaaggggcatgatcagaaaagggcctccctggacctcgtgcgcctgccttcctcccctcatggggccagtgtccccaggcctgtctgtctaggcctggctgtcaaagaaaggttccagtctcttcctccccatgtgccctgctttgccaggtgggtcagggcaggctggaggaaggagggtcagtcctggctgggcttccctatctcctggcagtcgtgggaaagacagaggcatcttcctcactggtggagtgaggcacgaatctaaaggggatgggaagaccttctgtgggtgtgagcatgggagtgggcagcacttagattcggagccatggatagtccggagtccaaggtctctgggtgagcagacagtcggccaaaggccagcctggagtcaaagagaccagacccctgcttagattgccatactcgcaccattccaaacctgcctccctcacaccctgccatgggggaagaggtgccgtcttcctccagtgcctcccttcccaggatctccccaccctgggctcagccagaactcccatttgggaggcttagttccatgtgtccatgaaggcccagcttctctggggagtgaccagctgcccaggagaaactcctgcatgcagaagagactcacaggtttgggttcgcaggcacgaactttggaaaccggaagagtctggcgcacttacaccaggctctaatcccccacctgatggctggcagcaaagagccaacgcaaggggcagaagcctgctcaaagtccagacacagtccgtgaagagagagcccctctcaagaattaggtccaggctgggaggaatgtggggggagcttgtagttcctggctcagtcttttctcaggggagtggcaccccagtatccacttggcagatcctagttggataactgctcaagatgcaaagggagaatgggtggaaagaacagtgacgtggaagaggtttgggatactggcctaagacatacagaaacgtgagttgggtttaggggacagctgtgcagagagatggggcatgctgactcggcaggtcaaggccttgtggctgctggccctatcgggcccctttgtctcatgaagattgagcacttctcctgtccccagccaactgtcctgtccaggggcataggagatagcccccaagttctatagctatagggttcccatcagttgaaacagatttgctttttcgctattcctcttcgtagccccaaattcgttgttggaggcggtctccgctgtgtcatgccatgagcaaagagtgaagagagctgtgtccacagcacgaaggggtctccttggccagtgtccaagccccctttcctggatatcttcagccttaaagaacagtcacaaggccacccattggttgaggaagtcattggagaatgggagtttcggaatctggctgccgagtgacagcatccctgaatcatgcgttccctgcttgtcccagctttccttccatcctccaccccagggaggatgcagggactggccagaatggaggaagagctggaaagactcgtgggcctcagtccctcattgcaggctgaaggtgggcagcggagcacatagtcttgtcccttccaaagcatggccagtttagactgattcttcctatctggcttctaaagtctagcaccctcctaaagttactcaccttccctggctctgcggcctggattaagctcatttctattttgcaacccattcccccattttcctctctttcctctcaaatcctagaaaatacatatggtggggaagctaaggaaatttctattggcttttccccctttctgctgctttgtgccaaagctagaatggaacagtcagccccctctcccttcagccctctgttcctccccacatcgactctggccggaaccatccatcttactgttctcctgcatctaaacctttttgccaccatctccctctgccatctcttacttcagtctccctcctgctctgccagcatggagagtgagggaggcttccaaaaatgcacattctgttcagatgaaaggaaaaggctggggtgggactggtggatccatcgtggacctgttgggctcatgtggtgtggtgtccggagactgtgacttcctgagggtttaaagactaaaatgggatggactgaggcgcgtgctgtgtgcaccacggagggctggcctctgcctggctcggtgggtgcagatgaacacacgtggggaatcactgtcaaatccagtactgtgccccacaaaaaagctgagtttattgctcacgggaaactctgcctcgaggcaggcaaaaatgctattacgggttgtattaggagaatatgggttttctcagttttcccagaatgaggaagctcctcaatgcccctataggaactactttgaaaagttaatgcaaacctttgaaagaaaggaagaaagaaaaaaacaaagaaaaagaatagatttatatgcctatatatgactatatggagtcctgtagataaatacgagcccacttttttttttcagcctatcctcccccacagaggctgctgcgctacttacaaattgaattaaatgagggctgaaacggcacgcttcagcatgtactgtagtcaccgtggaagaacaagtctttccaatattggggcatgtattgatttctaaaaaatgtctgcctggggaatgaaatatgcacatgtatttcatattcacagatctgcttccgaaaacctctctatttaatatcactcaattatgaatttgttttgctttcagaggaatggaatgcattttagtttttataaatttggggagagacaacactctgcccaggtaagaggagaggaagttcaggggtccagctgtccatactgctggctagaggaggagacagatccgggagaggtcctggagtgttttgccttttcctttctccccctgaccaatccatcctgggaaaccccaatagtgtcattgattgccacatcctgggctgcatcttctagcgcccacctctcccgaccccaggccagggctggacgtgaaagttgggcccctgcctggtctcggtgcatgtccttcctgcccacctgcttgtcttccttttcctaactctattcgtctttctctctcttctacacaaacacttccttcccttctcttcctctcgttcttcctctcttcccttctctgttcatccaacttgcctcaaaaagaaaaccatttaaagggggggggtgtctttttagctttttgcatctctgttgttgccattttcgaagttgagcccttgctagagattccgaggtcctcagtttcctcaaatagatagatatatatttttcccttaaatgagatgaaatgagtggcgtcctggggtggagggaggcgctggctggagtcggggctgggggtgggagggggtgagggaaaggttggggggggacgcatcactcaacgttgctgctgtcgaaggtgtggcactgaaagtccccgtcaacgtactccatgcctggcagcttcatcccgtacttgtccacgcaccagcagatgccacgtttgcggccacgggaaggtttgcactggggtgagtagagcaacaggcggtgaggacggccgcaccccagggctctgctcctccctgccctgcctcttgtctaccccaaggcaagactctcatccccagagagttgagggcactagacccgacccttgggtttctggtgtccccatttcacggaaagacccagggaaaatgtgaatttaggcagcctacccttggcaagctccttcaatccctttctttccttttttttttttcagacatggggtcccgttatgttgcccaggttggtctaaaactcctgagcccaagtgatcttcctgcctcagcctctggagtagctgggattacaggcgtgagccactgtgcctggcttatagtcccgttttaaatattacccatttgagttcccccaacgtgaaactctgcagggattctcaagagagttatgatccaataataatgatgatggtaataataataacagaaggaggcatgatttgtggtgttatcatgtagtagacaccactcaacgtttggtaggcagtaggtactgttctaagtgctttacaaagaccaatcactcactcctcattcaccattttacacaagggtctggaggcacagagacattaaatggtgagtaacaggacacagctagtaagtggcagagccaagatttgccccagtgtggcctggctcttacatttagattattggtgcccttaaagcagcatcagggtcacgtgtccaccccggagtccaccccaggtctaccaatcagaaactgcaggggtggggcccagccatcagccatgccctccagggataggatgcccttggaaatctaagaaccattgcccaaaggagagcctggctgtgaagggacatgaactgatttcaggtggttcacagagaaaatatggtttaaattcctgagtgtgcggtgcaccaatgatacgtgctgtgcgatagtgttacagagttaccttttgcaaggaattcatgtagctaaggcgacctgtggaaagcatagtggattaccgcataggagagaatgaggaaatggattacagcatagtagggaatgtggaaagtcatgatcgtggtatatgaatgggtatctgaggcccaggaaacactaagtggttaacggtggaaaccttaggcacttgcccaaggtggagtttcctggcaggtgccatttttggagcagtctgagcctggagctcagggcaggggacgtacctgctttctcttgtagaatcctttgcggtcacaattgggcaggtacacagcacggggcaccatgcgtgggctggctttgagctcctgcagggaagcctccatgtgtctgcggcaggggccctgtgtggacaggagggtgagaggcgtggcgagaccaagggaaaaccacccagctgcgctgacgaatggcccagggggtgggggctgaagggtctctggaggaaagtcaccacctttggttctaatcatctgctaccaaagatctttcctccctgtcacctgtcacgtgcgctgggatcatacaaagcctgcctttggccaggtacggagtcatactttctcttttgtgttccagtccaccccctcccctgcagcttttctcttctgctgagtaacaatgtccagaggtgcccatttctagatgctctaggagaatattcagtctctgccttggactggacacagctgcagggcccaggtacctggtacgtggccgctgggctggcacacactctcctcaaatgagcaccgcctctattcccacttacttgcacaagcccttggccctgacaagtgtatgctctggaaactctactcccacgtcctaagctgagccacatggtgggctgtaggtcctctgctgggtctagtctagcacctcctgccgccatgaatgtccatttagatgcaggaaaaggtcaaaagctgggagggaatgagggaatccccgagatgcacctgctcagactcctgtctcatctcaggtgcagagatgatccgggggtgggcagtgttctcggctcccccgacaaacttggactgggtcagcttctttctgcggtccttcttcactgcttcagccttcagctcggagatgcgggtgtgtttgggccggaagatcttgggggagtaggtctcctcggccatctcagaggtggtgggctcctcgtgctcacgggagtctctctctgcaggagaaggagccggagggtcagcccccgtgggccaaggtgcacacggccagagcccagggctgggcagtttggggtgaggggagtaataaaggctgaagcagatgtgtctctgccctcctggagcacaccctgaaagcagggggataagaaccaggaagcagagggaatgctcatttaagtggcaggaagtttctggcatgcttggagtcaagcagagagtgcaggcagggaggcttcacagaggaggagaatcgagagactgacagactgatgggtgaggacggagcaggccttctgggggcagtaaggaggaagggcaaggaaaatggcctctgcaaggatgaaggtggcagcgagcggtttgcttgctgggggatggccaagtagatgggacatggctggaggtggggctgagaagtaggaacccgggaatctgggcccatggaggcagatgacacagtcagggcgtggacgagaagggcaaaggctgtcctgttagtgagatctttgcactttcagagctgctggatgttgaggtctctttggacctggggaacctaggaggagggggtcctggggtctggagcagcagggtggtgaggaccttcataagcggcaggaggaggggaggggagagccagaaatgtaggcccggaggggaccggcgtggggccaagtggaagtcggaggccttgctcctgctctggctcagaactggcgcggtgctcgggggcctgggaggctgggacgttactcagctctggactgagagaggccgacagctggctgagaccgggacagttatatataggagtggcttgctgacagtctatacttagctggcttttgacctttagagaagtcagactttgttgatgtatttgttgatccttaattccacccgtccggccttttcttggtgcgcagttttcccctaaattctgatctcataggcatccatccctgggtccccttctcctctcagatccttgacctcccccagcctcagaggaaccagaatgggggaactttagattgttgtttccaggcgggcagcgtgtggccaggatgcctcacagtgggaccagatgcaggggtgagtggaggtggggggccctgtcttcattgcctccctcttttttcaaatactggaaagagaaaatagagctttgagtgaccttaaataactgaaatgaggtgaaagaaaattctgttctccatctactccatgatcactgggatgtccaggaacagtgaccgccagacatctgggatggggaacagaagaagtgggtagaattccaggaagtgggggtggggtgcaaggaaagagaagcttttttgagaagacgctgttttatgcctctgggcaggtatagaacctgacttctgagcttgcagccctgggcaagttccaggtgtgagttaggaaaggcatttggacacctggcctaacctgggcaggatggcaggtggcaggaagcacccaagcatctgtttctctcttggctcaggatttgtcaagtctaatgaaataggtatctggtctttaaggccttggcagagaaggtccctgccctaaagaagcctccaaaggttcgcagcgttcctggtggtgagttgctttgggtatttattcacaggaaaggaagggacgtaattactggagaggaagatgatgacttggggaaagcaaatagcaaggtggtgggtgggctctccctaaataaaattcaacctgagaatcctggtaccccttctggactctcaccccctcttcccagtcatgtcttgatgtcccagtacctcgattctgctctatcagaccctgctgtgacgactcatcaatagggtgacatctctggtaggtggaatgcaggattctagggattagttaaaagggtcatgttctggggtaaattgacttttcttggttgtagcgcaagtgagattggcaggaggaagggagaagcatggctggtttggggactttgtacaaattgaaaggctggggctccgttatctagtaacacaggcctcacgccaaggctcagatcttggagaagagggagtagggagagggagtgctaaccattgcacagaagggcttttgggcacgtcttatggagggactggagccgtgccactcaacctcagcatcaccacgcattttaatcctcaaaaagtagttgactactgtagggggaggggcagacaggatatggtggctactgaaagcctggagggggttcagattggagaagcctggaccccttcctcaatcaagattgtaactggataaagtgagggcaggtgggggagtgggctggctgctgaccagcgcatgcgtctatgcgtctccttcagtgggctgccccagcctggcctggagagccaacacattgtcacctcttcaaggggagacagcctgggaagctggcttctctcctgtggctggtgtagcagttcctggaatcctttccgtaggccatttagtccatccccctgtgtccaagcagaaataagcatctatctctctagttcttaaggacatctgaaatgggggtgccattccatcctcctctggctacctgttgggggaggctctgtccatttggtcagagggtgcccttttccagctgtcattttagcttattctctctttggccttgggggacacagaagcatggtggcccacagccttccctcaacagctcttctcaagacctttcaccttttgggactttttctaagaagtgctgtgggctgtccttaaccttgagtcaccctttctgggagggggatggggctgttgacaacggtttgataaaccttggggtaaatttattttgacctctcttactcttttctttgaaagtgttcaagtactgccccggggccaagcaaccatgatactggcatacaaaatgtagattcttgtatctctcttcatttaaggaactcaaaatgcttttgcaaactctctccttttcccagcctccccaaggcaagtctcctgagggcacaccttccccagctttgcaagctttttggctgcttctgaagagcaggcttaacattttgatgtgcctcctggtttctggtgccacttaaccccatgggacctattccttaggcagcagcagagtccagtgtcgaagatactaatcagggtcttgtggtcacctgtaggctccagagagacagcggaaacttggaggggagccagggcagagccatggagattaaagggctggaaagtaagactggagctgagtgccagaagcagccagcccgactcagctgctctgtggctgagtcataaataggctttcaattgtggaaggctttgcgttttagataaaacaagaaggaacaagtagactggctactctggagctatttcatcaagagaaaatgaactgaggttgcagaagggatctaggcaggatacccgggaggacttcctggtgaagattgttctgcacgtgaacagcaaaagaactcaacagtctgctctggaacctgtttgacaaacaggtcaatatctccatgtggccagcagagggcgtgggagactgacacccacacagcatgggcacacttctagggactggaagcgttttttgttttttttttttgagacagagtctccttctgtcgcccaggctggagtgcagtggcgcgatctcggctcactgtaagctccgcctcctgggtttacgccattctcctgcctcatcctcccgagtagctgggactacaggcgcccgccaccatgcccggctaattttttgtatttttagtagagatggggtttcaccgtgttagccaggatggtctcgatctcctgacctcgtgatccgcccgccttggcctcccaaagagctgggattacaggcgtgagccaccaagcccggcctggaagtgtttttaaaatctggaatttggaattgagagcggtggctcatatctctaatcccagcactttgggaggccaaggtgagtggattgcctgagcccaggagttcgagaccagcctggacaacatagtgaaaccccgtctctacaaaaaaaacacaaaaattagctgggcatagaggcgtgcgcctctagtctgagaaactcaggaggctgagaccggaggattgcttgagcccggaaggtgggaggttggaggtaggaggttggagattggaggttgaggctgaggctgaggtgagccatgattgctccactttgatagctccactgcactctagcctgggggacagagtgagaccctgtctcaaagaaaaaataaatctggaatttgggtgcctccctctcctacttctgcaataatcattcaaataaatcccttccttctgtttgtgtgtctgcaggatatatttaaagagtcagggagacaaacaagcgaggcccggagagaacccatgtgtgggagagtgaaggcaggtgagggagaggggaacagggcttgtttgtgcatggcattctgctgtttctgtaacctccaactggaaaatgatccaggaaggaagagagacatattccagacttccccgcccatgagatgctgttctgagaggtttttgcagaggatgggaaatgtggaatgctcagcatccatttctcctgctgggatctatggaggccagaccttaccttcataaccctattcaatgactaagggaggggatgatgataatattatctggatacagtatttacctttggggtgggatctaaatctctggcttctatataatacctccagtccttcccactggctctccaatgcctctggcccctgccacatttgggtggccaactcagtcctctttcattcataaggagttccccatacaccccagtgcagcagcatccacagaggcacacacagtacatcagcctctccccatggtaacatgaacacgtgtttgaggattgcaccatcctctatgtcctggcaaacacagagagtgtcatgatgcaagcccagctgctacagacccagaggcatcttagggtgagaaatactccatgctgcacaattgcacaacgcatgtaccctgcccaagctcaaccactttctccaaacctgcccttttgccacggctgttctcttccagtagagtctgaagggttctgactccaccttgcttgctggtcacagcaatggatggatccaggagacctgcctgcctaaaatctaaaccccccgcccccggacctcttagccacaccccggtgctattaacagcctgttcctgggctggtgttagtttatcactctatctcacttgacctaataatcaattgtaagagaaaactaggtgacccagatattgtgccttagcttacaaaaatcgaagaaacagaggcatccttgaaattcacagtccaggaagagtgtcgggctttgccaggccacccagacctggggagattctcccatctccttttctagacagaagataagatgaggacgcctagaatctctctacaaagaatgaaaaagggagctgaatttgttctgggtttcattctagtcccccctgtggaatttaaacagccaacttcttacgggcagagctttgtcatttctctttgtctcaccagcatatagtattcaataaataacctttaaatggagagatgtgtaaatctgcccaagaggcaaagagaagtaggtctggaagtatttctgtaatataagctggggcttagagcccagtgcatgccttgggaggttatctcatccatgctcctgccctggagcaagataaccctgccgcagggcacagggaagcagacagatgagcgtcatgggtgtgagaaacagcaggggtgctcctggattcactgggcttctctttggcctaaggctactatatattaatgtactacttaggccaggcatggtggctcacgcctgtaatcccagcactttgggaggccaaggaggttggatcacaaggtcaggagttcgagaccagcctggccaacatggtaaaaccctgtctctactaaaaataaaaaatcagccaggcatggtggtgtgtgcctgtaatcccagctgctcgggaagctgaggcaggagaatcacttgaacctgggaggcggaggttgcagtgagccaagatcgtgccactacattcccccctgggcaatagtgtgacaaaaaaaaaaaaaaaagtatatatttaatatggtagccactagccaatgtggctatttaaataaatattaaataaaatgaaaaattcagctcctcagtcactctagccatatttcaaggacttcgtggccacatatggacattgcagacctgcaacgcttccatcattgcagaaagtcctggtcagtgctggcctgacggcactgacttgtgcctgggtatggatgaaaatactgaggcccagtctagaatgttctgcagtccccctcctcccttgccaaccctaggtccctagccaacttgcagccaccagcccctccctacaacacaaggctggtggaagcatgagggattggctgttcactgtttgaaaaaatgtaagacatgtctcagtctcttgaagtctgtttcccagctgtggatgtcaaatggcttttctgcgcttgtgtgtgtgcatttgcagaaggagaaaggccacagtggttgtggcagggggaaggtgctgtggacacttccagggaagtggcaacatcatttcttttcctacccatcccatctctgaccagcagctgcctggcgccagtctctctcagaagacatttttttttgtttttgttttttgtttgtttgtttttgtttttacttgatcgtcagaaataggcatgcatgttccgggttctttttaacctgaattatgggctgaggaggaaatgagcactaaccttttaagaaaaaaaaaaaacccaaagctgtcatcctaaaaagcagctgtaagaatggaggaaagccaggaggaagaccccggaggggagttgagcagacttagagaactactgactggatgatgagggctataggtgtacccagctgagcccccctaccccattttaggccgggagaaatagcatggttaggtactctaaaccaacagcaaagctggccaagctgggaatatatctctatccttaccagagaaatacagacaccatgtagtatagtggataaccattcagaatcaggaaccagaccacctgggttcaaatcccagctccactactgaataggtacagcaaactgtgccaccctaaaccttcagctgtcctttctgggaggaagatgaagctgttgacaatagctcagtaaaccttgatgcagctttggcaacacagcaagaccccatctctacataaaatgaaatattagccgggcgtggcagtgtgcacctatagtcctagcaatggggagtctgagaagggaggatggcttgaacccaggagttggaggctgcagtgagccatgattgtgccactgcactccagcctgggtgacagagtgagaccttgtttctaaaaataaataaataaacaaaccttggtacagatttactttgacctttctttttttttttttttttttgagacggagtctcactctgtcgccaggctggagtgcagtggcatgatcttggctcactgcaaccctctcctcccaggttcaaatgattctcctgcctcagcctcttgagtagctgggactaaaggcatgcagcaccacgcccaggatggtcttgatctcttgagctcgtgatccacccacctcagcctcccaaagaccttactttcttcttcctctttccaattcagttttctcacctgtgttatggggaggatggcaatggccccttctccattatattctgaggattaatcagggtgatgcatgctaattcactctcagaacaggtctctgcctttgtagtgctgtttcctaccacctccctagttcgaatcatcaactaaaaatttggttgctgtgacacctggttgacagacgcctacttgtagaccacaagatctgaggctccttggactgcaggaaggtctgccagaaagtgttggctcgacctttgtctctgggggtctgttggccaacaccaggtgaggacttggcacaggtgctctccggacccgtctccacttagagagctccccctgggagtccttcctctgcctaaccccattccttcatgctgcgttaagggcacttagcctccttccctgaagatatatagagaaaagggggcccaccgccctccacagtgtagatgccacaggtgggaaggtgacacctcacagagtaaggggctgaggtcccccttacatctgccccactgtccagggaccagaggtaaagagaggctccttgttgttttctgatgccaaactaggatttggggttgtgactctggttcacatttcttggtccctgggaagcagctggcgataactgtacacataggaaatacacactgatgcacaagtccctggctgagaatctccagccaagcttcttttggagttggggaagggggagcatgcttagtagaagtgtctgtctgttcctcatacattccccaaatgagaaggtaatggtggggggataggtggggagcagcctctggaggaagcactgggcagcttttctcctggccactttcccatcatgacccatcacagccagttcagaacattgccagccacagccacatccccccaaagttctgcatgaccagaagggggcggcagggaggaagtagggtttacgcttctctcctgaggccccgaagaaggtgcccaggctctgctagggaccaaacaagggagccctgtctgtcaacgaaagctgagactccccttttttgagtctttgggagcaaaaggaaagagtggggacagcagttgccttctcaggtgagagaggggtttgctggtagccattaaccatgtgcagatacatacggaacatctgaaatgtggcccggggaactgaggaaccacattttaaaatttatttaatatttatttaattttaattagtttaaatttaaaaacagatactcaactcagttattggaaagattttaaagtatgtttggaatgcctcaggtatgtgactctgctttttcaactgtaaattttatgaaatctaaatacagatcaagtatttccaatgaaaatttagtgtctgaattgagatgagctgtaagtgtaaaaaacaccggatttcaaaggctaaatatgaaggaaagaatgtaaaatatctcattataattgttttattttgagcgtgtggtgaaaggatattttggatatattcagttaaaatgtattattacaattaatttccctgttttttttacctttttaaaaaagatgtggctaccagaaaattaaaaatgacaaatatggcttgtattatgtttcaattggaagtgctgttctaaatgatctggaagaagagtcatcctggctgaggtgacagaggggtgtcgcagtcccagttcgggataactggaacccacattaaacaactcagagaatcagcagaggtcatctgaggcctggctctgagtgcagattcagtgggaccttattttaggccagggaaaggggcctgatggtttaggttgagggatcaaacatgagataactgagttcgtttaaaatgttcctatagttcacctggcaggtctgacttaccggaaaaaggggcctatcttatctgcctccttcctaagcatcccagaaggaggagctgccacggcctccaggatgtattagaatgggtctcagcacttcctgcagcacaaccagaagtccccagctgccctctggaagcacatctctcctctcctgctgaaagatctgagacacatctgcctatgaaagaaagccagggggccctcatgctctcttccttatcagctttggtggtatatggttttccttctctccttcggatgcagaacttcctagttactgcactcaccccatccaaccacaccctctctcgatctctgctttctgttggcaccacgtgaggactgtgctgttggaagcgggccacttctgcaccatgttcttcaagactacaggccgctgcacagctcagaggcagccaggcctgcctgcctctccacatcaggagagcttcctgtcatgtagaaaatgaggtttggcgcatggacctgaaagctggggtgaacacccctccttcacaccctcttggtcctctttctctgaccaaaccactagcctaagccaggcttgtatgcaagactgtgtagaaaaagggacagaagtgagtgtgaaaataagagagtgtggccctctccactttggggccgcttcactccttttcctactgcccctaaaacagagtgccttcagattatgggttcttatgtcatggagtgatagcatctggcagtgtttgccaaaggccttactgcaggttagcccaggtccaggcatgagccccagtgactagcgagaaagccaggaatggctgaatgcagtgctggagcccctgcgggaaagagctgagtcccagccccttgtctgtctctaaccctgctgccacatcttgggcaagtgacttcccactcagggcctcagtatcctcattctaaaactaggaccttgactgtgatgatggctatgggttccttccagctttaacattatttggccaatacccagacaattcctggagagacactaggactgagctaagctgagtggccaggcactaactaactaacctggttaggtgctctaaaccaacagcatagtggccaaggtgggaatataacctctcctcctcacagagattttcagtcactcctctggatttatattttttaaaaagagagagagagagagaaatgacatcataacagaatttatggaaagaaatgaaactggaaataaaagggggggatttcactggtattgggggaggggagtagaagcctacactgccatccttgtttattttattatttatttttgcaagtatgtaatcaatgtgtaatcagtcttactgttttgaataacatgtcctgattgcaatttaaggatagtctctgggaattgcagcttttggaccaactgtagagaaaaagcaaatgtaaaactaaacaaacccctccaaatcgcctgcttgactcaacgcagccattctcccaccctcttcccttctgctctggcccctggttggtacctgctctttatgatcttcttccagtttctggatgtagtgggtctggagtgtggtgatctcttctccagagttttattttccacacactaaatatcttaaaagtttcataggcattgctcaggtacaaagtagaaactttagacaagtattaccttcccttcccgctggcttcttcgctccattaagggggccagggcttctgcagggaattcctgctcccatgccctttgctgtaaccctcacgatgacctctggctcctagggtcaggctggtccaccctctgcagctgcaggcccacctgcctgctcaaatccagcccaagccccgggactaactcacagctgctctgacttaaaactcaagccctcaggggatgccttagagttggggtggggggtcggggggtggatggagaaggtcggagggaagagtaggagggaggggtgagaaaggggaaaaagagaaatggaaagaatatgagctctcactagggctaactctgcttgttcttccagtctgagctgacacagcagaaaggtgggggagggggggcggggtgggcgggggcgggggcggtgggcggaggtggcgagaaaagtccagttaaagccccatctcgttttcccaactcccgttttggttggctcagggcacgccatcctctcaaagacttgtttcagagggagggggtgcgggtgggaaaggaatttggctccttcagttttccatgatcttgctcaacccagacataaatttggccaataaacctaactctggaactcgacttcaacatggcattttagaccaggcttggagttgaagccagggtgatggaggccaaacccctcaaagaagcaaaggctgaattcacttttatttaggtaatgcttttgctttcttttccagaagcctattttttgtcccacggtgtctcatttcttaatgacagaaccgaaagccagaacccacggctccctacatcttaaactgaatgtctcaccagcacagaggagacctacccgaaccccggtatctatgctggggaccagcccatcaaacctcattccccaccaaaaatgcccgaaagcaaacccagtacttccttgactccctccactcaccgctatttactgagctttgcccatcaaataactcccgtctttcatctccctccagcctcacacacattcttttttccgtatctatctctgctcctgaactggccagaatgaaatgcagagccaggctcgctctcagcaccctgctctcgggcccactccctctccagttgctcagcaacagcctagcaaaacaccctctcctccgccctctcctttccctcccagaggctttggctgcctgccacctcactctcttctgctccccatttctgattccagaaatgcaccttttttgggttctacatgtttggttacatataaatatatataatatagtatataccatatatacaatatataattatatagatataatatgtcgtgtgtgtgtgtgtgtgtgtgtgtgtgtgtgtgtgtgtgtgtatgctgcaactgcgggagggagggggcaaatccatatctgcaagctcagattttggcgggggtgggggagaggagggaggtaggaggtgtgttgggaagcaggaattttggctaaaggaccaaaagggcactctccctctctctgtccatttctctctccttaagaacggtctctacaccatctccaactttttggggacccgcccagtggttgtccggctaaaacgccctttccaggagcgcccactcccatcccatctgttcgggaagaagatgtcggcaccagcagcggtggagcgccgccaacccgcaacagcagccggccgggcacctgccttcggcggggtggagtcggagaggagtgctggggagggggcgggtagaagaggcggcttcgggttggcccaaaggcactcagaaggtgggggttgagcaaggggcggcagggaattctacaggggatcttgcttgggactgaagtgtcgtgtgtgtgtgtgtgtgtgtgtgtgtgtgtgtgtgtgtgtgatgcgccctccgtgctcgcctagcaattgcgcgcgcgtgcgctctgcgtgtacacccttcacactagccacatcacactacacgcttggtaaataataagtggagccaggatgcggctgagtgacaccttacgttctttcggtgtgactggattgttacccagggcggtggctcccaagccgggaaatcaattaatgttttccttctccgctaggcttttccaaatccacatcccccaagatgaaggcgggcaggaccgcctttgaaaagtggatcttaataaaaataatctcacaagccggtctctggggttcccagagcctgcacatcctccccttttcctctttttgcaggctgcaacctgcaaaaagatcgactttttgcaggtttggagatcgactacctcttgcaaagctagaggggctggcccctgcgccactcaaaccctgcagggtttgcggggactgaggctgaacacaggaagctctccggcctcctggcaagcgcggacgcactcctctcctgcactatagtgactgaaatttgcacttcagaaaactcatgttagggtgctcgtgagtaacggaaagggacagggagggagaaggggattgcccccgtaactaaactgtctccgtaactaaactacgccaaataaacattgtttagccaagttttaaccccttttggagagaatcaatagccagtttgacgtcttagaacccagacttttatgtagtttatttaactttttttttttttaactaaagatcaggtaactctttccaaaaagaaactcagtctaagggggtagaactgttctgattgaacaagtagctgtgtcaatcatttcaaccctagactcctggcgccgagaatttgggggcggcgcaacccgggggcggggcaagcggaggcgaggctcccagtgcgtggcttttctgtctccgccccctgaattttgcattctgcgtttccagggcccctcatgcacttaatccacacccacttgtgatctggtttaagagattggggagggcggggtggggggattgcggagggaggaattgcggggcgggggtggaggtggtggtggtgccaggaatctgcataggcgaggaagttgaaagctctgaatctcacatccccttttgcctcccagccctatgtccacctttcatcctaggtaaaatctgaattggagagggggaaaaggaattagattcagaaacgaacaccaggcacagaataccaaacccttcctttctactcttccccacccccaccccgcacccccgcactcctaaagtatttttttcccttcctgggataaaataaaagtcattttgcagttaaatatgttttaccatctaccacaggcaatcatcttcaataaaaagcaatggttatgcacatgggaggggcttcagggctcccacccgaaaggcattagctaccaaggatgtggggtgtttgtggtgtgtgtgtaggggtggagggatagaaacgtctggaggcacgggggtggaggggccaagagggacaaaggtggaattagctcagaagataggtaatgcctctctctccaggccgcaattaaaataatattttaacaaaagagattttttttccaagttcagaaaaaaacctatgcggggcgcgaggggggtggaggagggagttgataatgtaacatacactctttcagactgtagatagggtaccaggggatttggaccttgtgaccgaataagagctcagaatcagtattcggacagagtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctcggggtggggcaggagagcgagagtgcagggataaaggggccaagagggcccccggagatttttttgtttttgtttttgttttaaaatttctggcaggtagagcaggtgccctcccccagacacttgcaaaaatgtagagagaggtggagggctggggtgcctgcgagcaggtcccagttgcaagaattaaagccttgcaacaggttgggggaagcagggcagcgccaggtgcacgcagtgagcggaggccggagaaaccctcaagcctgagcgggtcagaattataggggaaaaaaagccacaaaattgttcacccccaagcaaccaccgaaataatgagatcggatgcagtggagatggcgttgggggtgggagagaaaaatggatttatctttaaaatttttgcttaaaatctaaaatacaccccgctttctaaccctcagctgccagcggtgcgcggcgccgcagaacaggtaagaggcgttggctgcagccgagagggtgggagaaaatgttgaaatcaagaaattaaaaaacaaaaacaaaaacaaaaaaaccccaaaccctaacacctcttttctcccactttgccacctcctcttcgaaattcgcaggttctacgcgaagtccggagaagggtgaaaacggaggaggggtaatgaaaaggagcaaaaaagggaaaaagcccacactgctttgcagctctttcctagctcttttcccctgcagaagtttccaaagagactacggggctccgggagagcaggcgcttttaaatagccggcccctggctgccagccagtttgtagctgcaatttgagcttcccaacacccaactcaggcaaggatgccaaggagctttgcagtacaaactcacacggggtgggggtggggagaggccttctagacacaagggggctccccttcgctccctgaacagcgccctcctcccctctgaacagcgccctcctccccccggaatgtaagaaaggggcaagggggacaggctggggctaccgagaatggggaggaggtggaggggccagtggaagacagagttcttcggagcagggtgaacacaatgaggagagtaacttcgtctccccttccctcctatcctttaagtagtcaaggcacaggctgaagggagacgtattttcttattagccaactggatataccgtgcccaagaaatcttcctaagcttctgcaattgactgtatgctggtgtctgtttccatgtggggtgtgtgtgtgtgtgtgtttgggggacaggtagtgtagaatggccagtgatgtctggtgagctaaatttaaaaaagaagaaaaaattgaatttctcccctaaaagtctggagaagaggatttaatcagggggtttcagtactcatgatgaagaggtgaccagttgccttcagctgcgttggccagggaggttctctctctctttctctctctctgtgtgtgtgtgtgtatgtgtgtgtgttgtgtatctgcaggaatggacattcatacaacagcattattgagagcagtgagttgcagagatggacactttggaggaaatgctaagtctgaaaaccttgcatggtggcctaaagtgtccttgtgtgtggggttcttagagggaagaaaggtggattggagtgacacttccctctctgtcactttgcagaggtatttctattgggcagggccacatccctggagggagtgggtggcagagtagctggaggagaccttgtgataggttgacaggttagttggtgcttataggcacatcccaggaatatgagctgacagggccacaggacctgcttggaagaggtcctgaccaggaaccgaatcatgccactagaacctctttaataaaatgaaagaaaactaaggccttgaaataggaaggtggtggttttagctttttctgaaattgacctgagtgagccatgagcctcacaggcaagtcagagagaaatgaccaatgtcactgcccctgctgggtggacttggtgtgggctgttacaccttttacattgtgcttcctcccttgagaagtattctaactttcctttggagaaggggctgcatttcatgaagtttgccactagactgcacccttatctatgataagaattctttctggaggactgctttcaagaaaatattttttcttgctcgttcagttcaggagcatctcactttatgccgttaacacccccagatcctgatctctcttctcacttatctatttgccgaaaggcacattttaaaacaaggttaacgtctaaagttatgtctttgcctgtattgccaaagggggtttagccacgtggtggctgggagagggaggagcattgtgtgtaatgattaaaacaaaaaatagcagcaaggctcatcttaatttcttcttttctcagtctgagggcttggtaaggtaggaacaaatcaatattcaaaactttggtggaaatattttagaagtgagggaaatcatgtgttattttgtcatttgtgtcaagttcagactacaagagtggcagcagaatgtgtgcagtatgttctcttccctgctcctatttctttctgcacacccttagcagctcagcctgcctcaggcacactggtagcttttaagatgattgggggaaattgtggtactccttccaaagaaacatgagttgcctcgttccagtcaccctgtattctgagagagatggcctctagtgacacctctttttgtgtagccgacttccaatggctggataatacaatatgtgaagacaggtaaaaggaggggggatcattcacagaaaagataaaaagggtagagagaaggggggaggagaatgtggtgggagccggaccctggggcagagcagtacaggggccatggagagaggttactctgcaagactgtaaatgttaagcagctattctttttttttttttttaatactttaagttctagggtacatgtgcacaatgtgcaggtttgttacatatgtatacatgtgctgtgttggtgtgctaagcagccattctttatctccacttagaaatgggcttaggttataagggattcagacactggagctgttgtccaagagaccctgggataggcttcccgagagggcatgagagaaagaagaattctcagtagcctgggattgtctatagtaatttcatccaaagatggaggactggccagatgggtgttgtttctgagtccataattaacatatgacaatggagtgggaaggtgttggtgttgttactgcaggatacgggattatggaggatgcctatgagccttacttgattccattttccccttccctccattctggaggtctagatctgttcacaatcacctttagaaaattgcttgtagaaaaaaaaaatagtttgcatcaaccagggtaattgggaggggatcattaattcctgccagatacaaatgttcccttcctagagacccccctgtgctgccggcttgctttcgctgtcatgggcttcccaactctggcatagactagcttctatacctgtcaactgcatctttttcggggaagtagtatttaaatatcaaccacttgtgtcccgtttccccggagatcactcctcctctttcctttaaaagattaactgcttatcaaagccagctttcaagaaatgcagcggagtgaaagatttatgatcttttatctggataacttttcaaaggatagatagtgtttttattttataaagcttcggatgccttgcctgtggtcatttcctgtgagtttctaagtgattttcaaggatgatgcctgataacacagtttgggaaagctagactttttagtaggacacaaagtattgtggattctactggttagaatggaaaaatgttagctaaggatcttgtcttcattctcttttctgtgtcactctcaccactctcagacaggcttatttatataatttattcaatttttaaagacctcatgacattgacttcagtctctcccagaggccaacacacatcaagaatactaatgctgcggccatgttgtcctggtcccaaactaaggtacagtgatgttcaataaagaaagtgcccccttgttcaggtccttccctagctctgggaggttcagcaagactgaagtctgtgttaaagagcagcatgaggcaactttgttgtagtgatattgctgaaggctaggtggcaggatagatacatcattagaaacacgcctcctttcacgaagggaaagaagcagatactggtagaggtgtttaacaatggggatggggcaacgggagaagaaaaagcatggatggaaggacaggtacggacaccctgtgggtccacttataggccaccccagcatcggcactgcactgttgccccaatagcaccaggccagcctgaggtgcaaaaccctctgtgtcccaccagatgctgtgttcatgattacttttctttggagaaaaggtatggccagggtaggaacttgatgactttgggttcatcaaagggtgtcctaaaccttctctgaggaataatcagaagtgatcttcagccacaattcataaaaattccccctgttaaattaaaaaaaggtaattatggcacatttcaaacattcaaagaacagaagataatagagcatgtgccctccactccctacacttatttgacacatgttcactttttgccgttgttgttgaagatttttatttttttttatttttgagatggagtcttgctctgtctcccaggctggagtgcagtggcacggtcttggttcactgctacctccacctcccaggttcaagcgattcttctgcctcaacatccctagtagttgggactacaggtgcgcaccactgtgcttggctaatttttgtatttttagtacagacagggtttcaccatgttggccaggctggtcttgaaatcctgaccttgtgatccacccaccttggccccccaaagtgctgggattacagtcatgagccaccgcgcccagctgaagattttgttaaaagagaagtagagtgggacagataacagctcacctcccatgcatgccatccccgcatcctcttccctggacagaggtagtcagtgtcctgaaatagctctgtatcctttctgcacaatatttttctaggttttatgtgtagtttctcatagaacagaattatagtgatttttgagggtaaaaccatgtgctactttagagttaattttgtagtggtgcttgcagtggtggcaatttaactagagtctaaattgaccctgaggctggctgttaaaggagccggagccagctgtgacgcagagtgatttatatcccgatgtgagccgcatataagttaatagctgcacgaattgatgttaaggaggcttctggagcagttccagacagatagggcagagcagggcaggctccataaatactgtttctggttggagcccttctgtcttcttggatcatgggatctggcatgttcctacaatggaccgctcagaagctgtttcaattttggaaaatgagattaaccaggaaaagtgatctgttgtgacttagagacagtgttggtagcaccagatctaggtgggagagagatagggtaggtagaaaaaatggaatcacatggaaaaagaggagagagagagagagagtgttaactacttgaagcaggtttaatatgattcatatgaaccgtgaaaaggccaagtaaaatcacagtgcatggttagcaactgagatttcacacagtttgggagggagaagtggtaagagctagcttaccactgttagtgcagagggtaaatttgtgtaaattaggaaaagatgaccttcctcaagatactttacttctattcatcagaatattgttataaaatacagattctgttaggacaggaaactttactgcctcttccaggaaattgtcataatgaatgtacctgtctgtgtctgctctgtgaatagcaccacttaaacggggttcttgctgtgtcgtacacaatctgcacagctctatgcaatggccctggttggaagagctaaacttcatatctaaactagcaggaaacactgcttttctactagtgtggaaagcatgggtccagtgacgtgatttgatccgttactggggctaagggatagtcctgaaacatttaaagcagctgcctctggccgtgttcccagctgggtcaatctaaacccctatgcccttctttccttagagaaatcaagcttttccatgcctccacacctgtgcacaaactcttcattctgacaggaacacttttcttcttcactgctaactggtgagctgctaattgtcattaaaaacctggatgaaatcacatctactttggaagattttgctgactctcgtgtgtgatttcctaagtgcatcttgctagtgcccctggaatcctctgtgtcttctttagtaaaatagggggaaaatattgtctgcttcaaagggttgtcgtgggacttgagtgaggcagtccgtgtatatcttgttagtgcttaatcaatattacctgctgtagtcccatcttccccattaaactgaggatcttgaagggccccaggttttattcatcttggttttcctcctatccttaccttttggacatgagcccttagtatagtttctagcacagaaggcacttaatacattatttttaactgaaaaacattgagtgtggtggctcttgcctattatctcagcactttgagaagccgaggtggggagatcacctgaggccaggagttcaagaccagcctaggcaacatggtaaaaccctgtctctacaaaaaatacaaaaattagctgggcatggtagcccacgcctgtagtcccagctgctcaggaggctggggtgggatgatcacccaagcctagggaggtcaaggctgcagtgagccgtgattgcgtcactgcactccatcttgggtgacagagtttgaccctgtcttaaaaaaacaaaaagaaagaaaaatatttaccacccctgaattattccagcgtcttccaacatcttcctaaacgcctgagtttatctttgcatcattttgccggactgttggtaatgtctatgttgatgtgtttctattatgttctttcatatactagtctggtcaatcctgtatattgcaaatgtagcttataaactctttacaaaaattccaatagagccctattgttggacttaaaatatgttaattgtaatgtaacttaaatatgtacaaacattttaaggtgtatgctctgtatgctaacctcactgtaaaatccaactaatatgtaaataaacccaactaaagttacaaactcaacaaagtgcaaaatgacgacattaatttgtgtgttgattggtgtttggttgatgttttgctgaaaataaatcactactcatgttgtgattatggtttaactgtgacagtgcaagtttttttgagcttggcatgcacatttgatattttgtttgatgatttaactctcccactactttttttttttttttaaaaaaaaacaacagtggagtcatgtcttgcatagtggttagttttaaagtcatcttgaaatacaaaaattgagtataatcaagattccccatgaaaagtccttaaattacttacaaaacaaaatggtactgccaaatcttcactttttgtaacatggcaccatgtcactcagccttcactcagcttccacacattatctcaggaccatgtctgcttctgctctttagcccatcagcaaatgacaatgaaagtggtgttacttggcttctatgccttagaaaatgaaaaaagtcttctagagctgaattaggtggtcatccagatgacctaaaatatgtttattttcgagattattagcaaaatgacacatacacacatatattgcaaaacaattagcatagaatatatctctagatcactccagtttgagaaatactggtgtactccttcactgtctttttcactctcatccaagatggctctgtactcaaggagagcataaatggtattcagtgactgcttctttggtccaggcccaaggagttacctcctcatcaatacaaggaacacagacacttgaccatgaaccgaaagctgggttcacagtttcacagactcttgagctgactagaactccaggaagctggtctgcagagattctgttccaacttttggtctgctggcaaggctgtgaagtcactcagtttaactaggcaattattgggttttaaatagactcaggacttatcctctgagagctcctttctaggccagacacacttgaccagctgggacaaaaaatctacacacaaccaaatgacaaatcttggacaaaaccacactttaaatataaacaacatgaacagtctctagtattatggctcatgtgtgtatgtgtgatggggggtatattggaagctacatacagagatgtcatggggccaggagagttggctaccaatttgttggtgaatgaggaaggaggagatactgtttacagcataaacatcatgacttaataggtccttcgccttgtgtagacttacaacaggttaatgcaccaattcgattaccaagcagagaacaaaaacatcttaacctcaagccaaccaagagaacatctatttaaagcaaggattgaaagaccaggctgggcacagtggctcatgcctgttatcccaacgctttgggaggcctaggcaggtagatcttctgaggtcaggagttcaagaccagcctggttaaatggtgaaaccctgtttctactaaaaatacaaaaaagtagccaggagtggtggcaagtgcctgaaatcccagctactcaggagactgaggcaggagaatctcttgaacctgggaggtggagattgcagtgagccgggagcgcgctactgcactccgggttgggcaacaacagcgaaactctctctctcaaaaaaaaaaaaaaaaaaaaaaaaaaaaagactgagtcgacagagatgtgggatttacccaattggcatagattaaatgtggagggtgggtttctctgagacccaaatgttgaatatcacgtttatttttattaaagcagctcatccttcagcaagttgcataactttttctggttcaatttattcttctgtaaagtggattatggtacgtatcagtggggtgttgtgaggactaaataagatcatctatgtaaatcacttagcacagcacctactacaaagtatattagtttgctaaagctgccttaacaaagtactacaaatggaatgacttaaacaacagaaacttgttgtctcacagtcctggaggctagaagtccaagatcaagctatcaacagggccgtgctccctctgaaggcaccacttctggaagaatctattccaggcttctctctcagcttctagtaggtcgttagtttgtggcagacttccatcttcatattgttttctccctgtggtgtatctgtgtccaaattttccctttttagaaggacaccagccattttggattaagggtccactctactccagtatgacctcatcttaactaattacatgtgcaaggaccctatttccaaataagggcacatttggaggtactggaggttcagactgaacatatgaattttgggggacacaattcaatccgtaacacactcaagtggtaattattattcacaatgtcttttaaaattaccttttggtttttttgttttgttttgttttgtttttgagactgtctccctcttgtcacccaggctggagtgcaatgacacgatcttggcttactgcaacctccacctcccgggttcaagcgattctcctgcctcagcctcctgagtagctgggattacaggcacctgccaccacacccagctaatttttgtattttagtagaaacagggcttcaccatgttggccaggctggtctcgaactcctgacttcagatgatccacctgccttggcctcccaaagtgctgggattacgggtgtgagccaccacacctggcctctgtgaatatttttatatacaaaattttcagaactgcatctctcttctcatagtccttctaggccttaattttgcctagaaaaaagtgccatgaaagcaggcagtttgacggctgtgttcaccattgcattgcccagggcctacaagagcaaccgacatatagtagatgctcaaatatttgtgagtaaatgaatgaagtctatttctttcctcctttcctctttctattttttcttttgattactcaatagccagcttctctttcttgttatcttttttacgttgctaaagtattaaaggcaaaaaaaataaaaccaaacaaattttaattttctttgttgataattactaaatcctccctaatcacttgctctctgcaaccagttagaaacccaaccagatgggaaagggcctgggagagtagggggtggggagagatgcctgtgttggagagagctggagtccacttggggcatttcctaggggttgatatgggccagggctgggagtctggaatgaatgggacttaattctactcaatagtctgggaagaaataaatgaggtcaatattgaccctagaggttcaaagtcaaagtttaaatgaggcaccaccagtaaaggccccaaagatttggtcacctgcatcagatggtttctggcctgcaaacacatagggagttgtaaaatcttgg

SEQ ID NO: 1107 - DNA, 27881 bp, Homo sapiens
gtgtatgctttaacaataaattattaataaatagttatctgtgttattcaagatataattaaattgttttttgtgcactgacccttacctttatttcagatccatcacagagagtgcatggaggtatttaaactgcattaactgtttcacaattaagtattatcttatcaattaggtattcaagaaagatcacttacagaattatagatggcatgagctagattttactttctaaagaaataaccagatacatgagcaaagatgttaatacaaagatgtttgtcacaacatggttttcaatagcaaaaaaagagagaaaaatatataaaagacaaataacagtggataggtttcaataaataatgttacagtgatacagttaaatactatacagctattgaagcatgtcattattcatatttagtatggaaagatattttgctattttgccacatgaaaaaatgaggttggaaaaagtataggttttgtgaatctgttgtatgaaagctgtctatagttacatgtgtatgtgtgtggaggaaatagtgttgtcattggttttctgatgatgcactcagaaaagacaagtattcacattttttcttgtggctgatctggattttcaggtttttctacaatgaacatgtaggctgaacattccctaagcaggagagtcccacctctaacatctcctgtaggcctggcaatggcaggcaggaaagacagaggaaggaaggagggagaagggaaggagtgaaggaaggagtgaaaaaggtaaggaagaaagggaataggggaggaagggaggaaatgggaagggaaagaaggaaaggaaggaaagagggagggaagaaaggaagggaaaagggagggagtgagtgaatgaaagatggaaagaaggaagaaagggagggaggcagggaggaaagaaagtcgcgcttcccttgagctgccatgggcactgactcttagggtctgaaagcccctgagatgcaaaagcctagtgctcacaaagagctggaaagcctcaaggaagttcttcaatatttctggaaggaaactgtctccagaagcttccctccccacgacagataatgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcactgctcttagagttttcccagcctttttcaaataggggcaggactggggcaggccatctcacaaggggtccctgatgctgagggggataagtgaacctcccagtctagagctccagccaagtctatccaaggtgggaacgggggccaggatccctgctcagagctccgccattgtcccccatcacagtgaatggatgtaagctcacccactctgtgcccctgcctccctgctactctttggggataataataaaacaaaaaccattaccatcagtcagtctgtccacccactggcatgtaccaagccagacactctgccgtgttctgggctttacaacagaggatgagagtggtcctttctctcagtctaataaagcacttcccatgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactctgaggttttctgaagtaaggcaacttgttgaattgtatttagccatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcagagatggggcaagaacctagggctctgactcaccgtgcagcttctcttccagcaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattggggcagcacaaaccaggctctaagcaaaggcaaataaaatactacacctctcagcaaagtgaagacacaggctctggggccacctgaagcttctatgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacacgtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatgtgtgcatgcatgtatctgtgtgtaaccatgtatgtgtgagtgcaggtatgtaggtatgagcatgtgtgtgtatatgtatatgtgtgcatgcatgtatctgtgtatgtatgtatctgatgtatgtgggtggtgaggggatgtacagagaggaatgagaccctcttttgctctcagcaacatcacagggtgtagaaagttgtccaaacaattccaaaggggggcttatcaagacagggttcagaaaaaggcctgagacccaagggacattaaaggagggggttgaatctattttggggtgtagaggcttgaagatttgaccctgaactagagggtggagtggaggtggtacaatgtgcttccatgccttgatgtccactctgagccagtggacaggagaagccatgtcatgacagctgctgagaagcctcccttctgcccagcctgggggcaggccgtcttacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaatgcatttgttttattattgcaattttctccaatattttttattttctttctcacaatgaacaactatccttcatttacccaaatattctatttaaaagctaataatacagcatttgttgagtcatctggttctgcaagattgagatcctcttgtcctatgtgccaggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacacccccagctatctgatctggcaatgtttgtatgcacctccctgcactgtagtaccttaacttggagtctgtggcccctgggatgaccttaaggttagggacatataagtttgtctcttagcaccttgcataatgcttggcacataatggaaacccaatgagtatataatgtagaaactatttctccaccctggaatattctctccttctcctccacccatctaaacaggcccacctctaagggagcagcttaaattccacctcattcttgaaggtttctccagcctgaatttgttgcttcctcatttgtaggatgacagaactcagaagagctttagccatgatgagccgacacaagtcagtagtaaaagaaggaatataaaatgcctccttcaggaatgtacaggctggacatcatgactctacaagtgaaaaagagttagtggctttagatttctgcaattttggtataaatcactggcctggacctgtatttacagagatgcaatactcacatcatgtggggtttgtacaaattgcagacatcgaggaacagagaatgttccaagggcaggctgtagggaagaggctacgatgtgggaggtattatcctgaaaaaagcaatgcacagggagccctcttcaagcacttaaaggcttgccaagtagaagaatgtgcttgttctgtgtaattccagaacacacaagcagaaccaatgggtgcaaattatgtggaggctgtttttcctatatgacccccatattttaaccacaaggaccacaaacattgatagggtttcttcaagaggttgtgtggtccctgaccctggagatgttaaggcagagcctaattaaccaatttctcagggatgccatagcacagatttctccaattggagggaaactatgattccatgtctatgagatggagtttcactctgtcgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaacaacaaggactgtgtattgaatgtctgtgtcacacagcagtgtaaatgctgggtaaacactcattggttgcctgacatagtaactcatgctttaagccttcccatagaagggtgagagattgggagagtggaagaagaatgatcactggccttagaaagcagaaatctggtcccatttctgcccatcttttctcatttctcatcctgcaggcatctgagtcttagacccacctatcccacttcctcaagaagcccttggtggaactttgcaaatgaccaaagagggagaattataataaggttgttagtttccagagaacattacacctaagcttctccacgcttgtaatggagggatggatggatggatggatggatggatggatgaatggatggatgaaagggtggacagaagggtggatggatgggcacatgggtggatggatggttggatggatgatggatggatggaagaatggacagatgggtagatagatggacagatgggtggccgggtggatggatggatggatggactgagtcaagtaatgtcaattagagacctgagtgttctttcctctgtgctctactcacactatcatatttcctagcagtccatggcacatgatgtctgctcagtctcagggtgaatctgaggtcaatatctttgcagttgggtttccctagatgttctgtcccatcaagctggtaccaactaattaaacccactgaaaagcagagactcccttctcgtctttccaaacagagtcacactcacagtgctatcagccccttctcttattctggctgtctggccacagcctggattccggcatcagaatttgttctgtccttgggcttgccagacatactttctcttgtattcaccacctcttcaagcctaggatggagccccacggggcaccaaagatgtctgaccccagcactgtttatctggctgcaaacccactaataacatagtcaacgacagtcagtacagagcaggggccccataccttatttctgccaaggctttatggatgactctctcccccttcaacaaatgctccttaatgttcccaccatcttattattcatgctgtaccaaagacattgtgaaatgcccaggctcttcttccttcatgtcctgcagccaattatagagattggtgcaggcctgacccacctgtaccagacggtataaacacagcgcaatgccctggagaaatcagttggagtctccagggatcagggttccaggaactcaggatctgcaggtcagtgatggacaggcaatattctctctctcttttctttcttttctactctctcctgtcaatatctctggtatgccctctatcccttcactcctcctggcaagctgtctaggtaacaaggtagtcccctcatatgacatgatgggacatcaaaaacatttaggagcacataaagagatttgaggagaaggaataggttaagccaaatcaagatttctgaactacttagaacaactgactttagaaagtaatctcaaaagaaaccatctgggccaatggtattcaaaccgtgtttggtggaagcttaagagattttttgttttcgttttttttttttttgtgctccttggtagctcctcagtgtcttctttgtaggcaagagaaatactagcagggttccaaagtctccattgcttcctgtgtcagcaaagcagctgccctttatcctttttacaatcattagaattctgcataaaattttattgtgaaacttaaaacagttttgaaagataccttactcaatctttccatccaatgttgataagttgaaggcccagggataaaaggtggcaaaataaattggtagcagagctaggtctaggactcagcctttctattcaaagtctgctctgtgtgtttctatgtcctggccacaaggaccagggtagttcaattagggtggttggagagagcttcaagtgagctgtaagccatgcttcatgacttcaagatcttataaacttttataagggaaacaaatatctttatgtacaacaataaataatacagtaaaatttaataggagttcagagtagagttacaatagtaagggaaagattcattaaactctgagtcatggaattataaatagtttggcctagaaagaaccttcataaccacataatctaatcccatgaatgtatagtgctgaaactgagggttggaggttaaaagacataaccctgtatgtctaagctgtaactctacactggtaattaatttgatagaactagatactgaacccatctatactgatactatctccagtgatcttaatatcaaaagatctgaatggatgacaatgagaagggatgacttttgaggcagggagaacaatgggacacctgtgagtacgtccactgagaagataagaaaggaattatgtcgccaggaggtgtggtttagtgtccatggagaagtgagatgctatcacacaagaaaatcagtgccagacggtgacaaaacagtcagtcactgtagattctagagctgggcagggatgtggtgaaaaaaatctttagaacgtgggtccacattcctcacataggttggaatgaatgaaaggcagaaaaaccgggaatacaagtacagtagtaatggcaattaaaaacacaaagttatattttaaagaaataacctgtagggacttgataagttagacactgagtcaggagaagtaggagatattgtcaatgagtctcaggttttgaatatcactggtgagaggaatattatgacagtgagagaaatgaaattgggaggaatgtgtgggctgggaggagaagataattaacttaaccttaaatatatttggttggatatcagcaggatgtccaaagtgggctgtcctgtaggctgcaggaggtaaagtgggatgtgcagtctacatttgggagccattagcccaagataatcattgcagctgtagaagtcaatgaattgcagcttaatatgatgtgaaatagaagtgcttaggaccttgttagccttaggggtggccccagaaggaggtgaaatctacagtgggagaaagaggtgtgaagggagtcattcaatgtcaagggttccaaggaggcaatgactaaatatcaaaggaatcaaaagaatctctggatcttgctccacagaagttaatattggtcttggacagaacatcccacatagatactgtgcaggagaatgatgaaggataggacagggtgctgtgcaaaagaacatggggaaagcccaagtttagctgatggcagtgtttgagccaggacaggtgaattgcggaggtctgagagccagatgccatgtccagggagaaatgagaggaagaaaagagggatatagactgaagttcagtgaaaagtcatttgaggaaaatagggaggggaagctttgggggtgaggcatgtggcacactgggaggggcttggcacacagcagaggttcagcaccaagacccaggctctctgatggaccagacgctagcttcctacccttactcacttcatcacaatctatcagaacccaggcggagggagccgaataggggagcctttgggaaagacactgtacattttggctgtgccagaatgggaggtttctagggcccatgggatccagctggactggaccagcattgaatttcttccagctctttgagctgacactgacccagagtgggagtcatcagcttgctatccaccttcacccagggccctccactttgttgccccacctagatctgggcacagctaccacactgcccactgtcctgctgctacaaccaaagaagccccagtggtttggccaaggggagcccatcatcaagtgggcttgcattgaggccatgatgctgttgagttatctgtactgggggattgtctagtcctttaggactcaaagtgctggccaggaggaaccagcagcattgacatcacctggttgcatatttgaaatgtacagtctcaggccccaccccaggcctgaaaaaccagaatctgttattttaacaagaactgcaggtggtttatatatttattaataagtgtgaagaatggaatgaaagtacaccagttcccaagcagcatggctgattgctggaatcactccaagtcctactgaattagaaccttcggcccaggaaatagtaattatacagagtcccccaggtgatgcagatgggcaggcacatttaggagccaatgactttaactgaacacttcatttaaaaaatgttgaaacttacttgatactacaaaggaaattcatgttcattataggaaaatgttgatatgtttaaaaaattactcataaagccataggtaagtggtgcaacaacacgagtaacatttctatgtatgtgtctctatgtgtggatttaaatagaattacagtgtacacttgatttataatctgcatttttcacctaatatattttgaaaatttttatgtcctaaaacaagcttctataatatcatctttaacaaacacatacatccttatttattgaattttgctataatttcttagccaattacctattactgaaaattcagatttttttcaacttcttgctattgtaaaaaattatgcagtgaacatttttgtaagtaaacatttgggcaatccgttatttttcctaagagtaagggaaacacatgcaatcacaaagtatacagaatgctttaagactttcattcacagcaccaacatccctccagaatttgcacttgttagtccctattatccttcactctaagtctcaaagtcataccccaaggcctggggacagaaaatgacttgtccaaagtgacagtgacagacccagtactaaaagccaccttggctacagccctgtttctggaacttgagagctgaggtggttggaagccgtatcctcagcacccacctgttccttctcacctgcctccccagggtccctcagcatctctctattcctccctgagccctattactttcttccacctgccttcttcctttctcttctctcattttctgctttcttatattttttcttctctattcccttcttatttggtgagaatcagatctactcggtaaacctcagccctagtcatacttgcgttactttcctgagctaatttccaactcctgattagctctgggtttatttccatgctaaattctggactggcctttccaatgggtgttcattttagggaagagctctaggacaggataacccatcgggaaggagcagagtcatgtgaggctgtgtggcctggcatttatacagggccactatcttcactgtgccattttccatctggaacagaatgggggagtttggatgggctgttttcggcagtcttggccaagcacttctagtcactaggaatgatgttttccaactctctggggagaccccaccagcctcactgctgctggagaccccttctagttgtgctctcttctttcactctgggctctagttatctaacccttggctagttatgggggcgggggtgtggtgccctgttggccaacagggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacatgtaagttgtcctggcatgtccctgctttccaagccagggggtcagggtgggaagaggaaaggaatgctgagtcagaggatgaggctccttctcaccttagaaattgcaagtgccccataattaagcttcatcatcaccacagtagcaacagctctttcctgaacgtctgcaagatgccagccaatctactgcctcatctctgttccaaaaagtctgtaagtggagtgttattaaacccattttacagatctggaagctgaggctcaaagagggtaaataacttcccccatgtcacacagctaccaaaaggcagagccaggaatcagacttcatgtcctctgtgctgctccatccgcctctctgaaatgtcagaaagttttgaatctcaatgacagcatcttgatggtggtccctgtggcctttactcccagtgtgggcttctaacacttacttacatttcatctcatttgagatttgcatccttccttatcttttactactttgttgtctgtgattttgtcataagctcctttcaggaaggaggtgaggcataagaaaaatcaaagaggactctgggatgcatttcctctgcccctcccatggaccctgtaatgtccagggctgtgtcctggacaaggtgggtggggagcagtcctggtctcaaggaggtgacagcctggctgggaagcaagacacatacataggaagcacataaatgacaaagcagatgtcagcacttcagggcatctaatctgggttctggtctccaaatagaatgctgctggcatgtgagttgtcacatctgggttgtcaaggtggcaaggggaatgccagataacacgcccaggatctttccggaagtttatttttattgtacaagtgaacctgctttaaatatgtacagtcattagctaagggtattatcgttagctgttattgagatagaaaaatcccctggaggtggtggaatttgtccagaggttctgccctaaaaggttaatgagagctctccagccctgacagcagctgacaggcatctttgaaaccaactaggtgactgagctaataccctgcatgactttgaagcctttaaaatatctgaaaagcaaatcacacttcagtatacactcaatctctgtactaaagagaataaacatttataaacaattagggcaggcccaaaaaatttaagataaggtccactgtatcccaaagtcatctgagcctcactaagaaatttctcaggaagccaggaacattttctttacccctctgtcagagggcattggctctccgttctcctctgaaggcctccccaagccatgagaaggcaggaagcacagcctctgaaaagcaagaacacaggagaccttccttgctttaaggctggcctggtctttacctgctcttgggagtgaccattcccctcttaccacctgtgaaggagagaaaatcgcccaaatgctcaaggtggtgattcagagcatggaagtggaagggcttgggggccagtggtgcataaagggaatgggccatcagcactgtcatactgtttcagaattaaatatgcagaccagaaggctctatacacaagagatggccagctgctggtgggagatcctgttgcagacaactgctgtgcaggtgagcttctggggcctccaccccatgctccatctgccataggccctcccttctcttcttccctttcctccccagcagagggtcagcagctgcccccagtgacagtgagaagggccagagagcagctgtggcctctcctagcgaggggacatgactcctgcagaagtcctggctcaccgtccagtctgcatgcagggccaggccaggtgtgcccatgtccagttccttcctgcctgagcctttacctgccaagagcctgcaacatggggttcccttgtcccttgactcttctctctcttccctcctagagaagatctgcatacttcctaacagaggcttggcccgcaccaaggtccccattttcctggggatccagggagggagccgctgcctggcatgtgtggagacagaagaggggccttccctacagctggaggtgagaggcctctccccattctaggggacactgcagacctggcctgacccctgggatgctctggcatctttgtgcctatctgtggattcccagccaggtccacatgtcctacttcctcaggtttccaccatctccctctgcacctagcaccaagacccttgccctctagaatctgcagaaggcagtcccttgggtaaaaaccagccctgtcaggtccttttttggccaagccccagaggcctccagggctaacacctccatcagcactctcattctgcagccatccaccttgcccccacaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaagtttgtggtaacttgctatagcagccatagaaaactactacagagccttattcgaccctgtgtccagtgtttgatgcaagagacttggtgagttcttagaaggctacctgcagcttctcctccagtccatctgctatggagcctctagaaacaaccaagaagccccaggcagaactcagtgtcctctgcacagggacaaagccctgggctgcttacaacttaaattctagctcaagtcttgtgattttctaccagatacttcacagtgaatccacaattccgtggttgactgttggtacagtccgctatctgccaggtgcttaagtagtagcaagggccagacaatatgtgtgtcctggatgtgttgagtttaaggttacagtggagtctctaagttgaggtgatttgatatagctgggagtacagggctggaattcagctgagagtttgcaattggaattcatactcatcctcagagctcaaacgcttctctgtttcatggaaaatatttgactgggatcaagctagagcagaaagcccatggtatcaggactcagagaaggcacaggctgctggcgctgtccctctgttgtataactacttaacattcacctagcgtgttctgagttccaaccatggggcagcaattttaagaacattctgttgtcatcctcagaatgactcttcaaggcaagcattttcacctccatttgacagatgaggaaactggactaagagaagtgaaataacttgctgaaggtcatatgggctatcagtgttggagctcaagataaaacttggtgcagctgacctcaatgccattttgcaaatttttattccacttaaggagctgaggatagaatggtgaataaaaccaaacttccttgtagctgataattgaaagggagaaacactaaacaagcaaataaacaaacaagaaaacagaaagggcacttttcatgattagaaggtgagggcagcaggtattcaatggaaatattagatgggggggtcaggggaggttttttttttttgttgttgttgttgtttttttacttttttgaagaggtaacatctgcactgaggttatggacaggaaggaactgtgactagaaataatcaaggcaaaagagtagcaaatgtgttggccctgagacagaaaggagctggtatgttcaagtaacagtagaaggctggggtgggggctggagcctggagagcaagggaggagtaggcagtgagcaagaccagcagggttgggtcatgtgtggccttgaaggcaaagtacaggcttccaagtattaagtgtgacgggagctacacgataggctctgataatgtttaggttctttctctgagctgcctctccacagcctgtatgtgccccgggaaattgatcacctggctggcccattataactatgtgtttacatggtgggactcaattttatgtcagctgtggccagaacagctgctggtaaatgcagaagaggctgagtaaatgcaaaatcttaaacaagttaatggataatcacacttgattcctattcctcctcctcctcctccccttcttcttcttcttcttcctcttcttcttcttcctcttcttcctcctctcctcctcctcttcctcctcttcttcttcctcctcctcctccttcttctccttctcctcctcctcctccttctcctcctcctcctcctcctcctcaggacagggtcttgctctatcacccaggctggagtacagtggtgcaatcatggctcactgcagccttgacctcctggatcaagccattctctgcctcagcctcttgagtagctgggaccacaggcatgcatcaccatgcccagctaggttttttttaattttttgtagagactggctctcgtcatgttgcccaggctggtcttgaactcctgggctcaggtgatcttcccacctcagccacccaaagtgttgggattacaggtgtgagctgctacatctggccaatcacttggttcttatgggacattcatcatactgtgtgagaagagctatggtaccaggtagagacaccattgtagcctagaggtggagctggcagggagggctgggcagggcttcacagaagaaagagcatataatctgggcctcagagaaaaagcaggtgttttccaggcagagaacgcagggatgggcatcccaggcagaaaaactgctcaggaaggtgtgatgatggagaagagctcccagcacatctgaggtgagtcatcaatgtggctgggacccagggcttggactgaggagtggctgcaaattcacatgagaagatgggtggctcctgattgctaatgccttgtgaaggagtttttatctgggaggccccaaggaatcatccaggtatttcaggcaggacccagattttaatcctgggcccctcagatcagcactgggccaacacagatgctactgggtcctcagctcttctcagccaccccctccctccccttctccctccctgacttctgtttagcactgccccggggtcagcttccatgctgtgatttcacagtcagcctgacccctgcttcatcttccctgaccagttcatcaccttcatgcatgtgttgaaagacaaactttggcatattaaaattttaaggagtttatttgagcagagaatgattcatgaatcacaaggtgccaaattgcaagtgattcagggctccacccaggggctaccggaaaaccatttataagttgttcaggaagcaaaaggaagaaaaaaattcattggttaagtggaaaatccttagttgcaggttagtcggcggttcctgattggctaagcttaagtttcgttttcttagtcaatgaccattcactctgggttgggttttagtttacttaggcaggaacccaacacgctggagtcatctcagcctaataccttcccaattaattattttaacacatggtaactcatttctgctggcccttcccttgtgaactgtgcccatggaccacccaggcaaatgcaggcctcctcctacttactagtggtgctgttccaagttgaatcatgttctctatataactaaaaaaaattttcacatgtaaaatatgccaattctctaacagtgcacagaagaggaagaggacataaagacttagaagacatgtctctatgactgaaggacacatagtgcagatgggaaaaccagaccttgtgaataaaagctcatatttattgactgcaagacactccaaatagcacttagaatcaaattctgcaggactgtggtagaaatagtgatgggactttctggcactagggtttaaaagtaaggaatggaggcaatttctgacaggtgcagttcagcgatgccaagagtattcttctcccacgccccaaggctcattccttaaattccttctcctccctagaaaccacaccaaagtcttcactccaaaacctaaccaggctagagggttattattatgtgaattctagggagaggtacactttaggtcttatccactatttacatctcagaatgaactggtaggtccagagagagagcaaacaggcaattaaacacagtgtggccagctttcggtcaggtagcaccaggagcagggtgggtggggagggtgaatgtgtgtgtctgtatgtgcatgacgtgtccatgtatgtgtatgtgtgtgctgtgtgtgcatacgtgcttacaagagactccagatgtaggcagcagttgattcacagggggcctagtctttgttccaagaagctatggaacaacttcacacaagagggcgatgaacccagggtctcctataacctgtgtttcctaagtcattccaccaggattcagaatctagtcactcttccctttgacccaaattttcatctcgcgatcctaggcccacctctcgcatcacaatagcccctaggaataccggctcaaaacattgtacagaaaactccgcaggacacacaactcatgtcagttctagggaaatctaaactcagatttaaggaggaaacagtaaaagtgaaggaaaatgcagacaactttaatggatactaacttttccttgatataattctctaaaatatacagctacttcataaatgaacttgacagaaacaagtgtaatgaatataaacagtaaagttaacatcttggactgaagcactggcattcggtttacctgaccttatttctggttggattttacatttgcataactaaaagggttcaccagaattctaccaaaacacagtctatccccagagcagattccaatctccgccctcaaaggcacagactccacgctatctagaggcttgatccccctgcccatttctgaggctgggagcctgcagtgtggcctttgggctaaagatggcgacagagatcaatgttggcgctgcctttttggggctaggttctgaatgagctctaacatttaattcttcaaatacttagcagctactgtgtgtcagcccttgtgcctcaaatccccgcctcacttacagtagatgcatccttccacgcaatgcgtgagagtagaactggatcctgtgatgacttcaggaagtccgggtgtccattctgttgggtaacaatttttgttagctcccccttgtcacgagggacacagcccctgctctctaggagtttggagcttaggagggaaggtagatattagacacatactcatttcgacatttttcccacctatgtgaaggagcatcacacgaatgcttgatcccttctccccatgacagagacgttgctgtgaatctgtctcctgtacactcattccctccaattcccttggatgttcttgcccaggctctggtcacagaattgggtgacaaaggatgctgggagccttgagttctagcagaggctcttccatactggaatatttctcacagacattttctgaaggtccatagtcacaggacccatgatacaaaaaatagcactggttatgtaagtttgtctgcataaaggacagcagacgtaggtatcagctagttatgcattttgtagactggttccagtgcacacattccaatgagtgctcataggtttatgtgagaaaatgtgttatttttgataccttcttccacatgcctctccctgttcacaccctctgcttcagacactggtctcctcacaattctccaaagacacactctaggcacgatgctactccagagctccagcagtagccttgtgttttgaacacttgttccccaattacctgcctggcttgtttcctcagtgaggcctacgctggttacccccgtgaaaactgcaatatgcaccccctcaaatctcagcacccttagattacctatggtactatcacattctaatacactctataatttattttttatttactgtactttttttcctttatcctccactagaatgcaagatccacgggcagaggattttctttttgccttgtttatgtattaccagcatgtacaagcatttatgacgtgtcaagcactcagcaacatttgctgaatgaagaaaagaactcaaataggattcccaaaagggtcctacttagaggtcatgctctgcagagactagcaccagggcccctgtccagatttattaggaaagactgtggcatcaggtgggagtagtgggaagagggtctagtctccagaaggagggctggtgaggggtggacaggatatcagggtttccagtcaatatctgaatcactttgcatggtgtctcagttatctattgctgagtaacgaaccaacccacaatgcagtgatttaaaacatcagtgattcattattccttctgattctgtgagttgactaggtggttcctctgctgatcttgccagggctctgttgcactcagctggaggctcaactcagctggaaagtccaagatagtctctcccatgtctggctgttggtgctggctgttggttgggggccttggctattcatgtgtcctcccatcctccagtaaactggaatgactttcttacatggctatcttagtgttgcttctcaaaaagggaaaggtagaagctgcaaatgctcttgaggcctagggtccaaaactcacatttgtcaggaaggactgtggcagtgggtgggagtagtggagaaagggtctagtccccagaagtggagctggtgagggtggatgggatactggggctcccagccaatgtcagaagcactttgtcataacctgcctcatgttattcactcctagcatagcctgttggtctaagcaagtcccaaggccagccctgatttatggagacgtgggtagagaaatggattcttcctctgaaggggaagatctgcaaagaatctgtgcccaaagtcactgtaaacaaatggaagaggagggggtaaagcacaggctgactgattcgtgaatgtgcactcctgaccatcatgctatgctgcctccatgagaaactctgacatggctgtgtagccagcaattcattcattcattctttcatcaaatgttactgaccacctgcaatgttcaagtgcagaactgggcagggggcatacagaattgaatggggtccaagatttggtgctcctaaggaagatgagaaagccagccttagccaagctctctcaaatcttcttcatcttgctctgtggttttaatgctaactaggaacccaagggagagggtcagcccttggaatgtcttccagaggaaggtgaagcccagctggagtcccagtctgtggcaagtaaactgggagaagcaaggacaggcttaaggcttagcttctgtgccaggggctatgtgtaaggtttgacttcctagccttctcaggttcacacactactcctcattccttcatgccctcccaagccctgaattcaatgttgggcaacagtgagagcttaatcaatggctttgaatgattcttaggcaagctgagaggaatatcaacaaatgttttatccgatattcccaagagtagcctgacccaaatccaagattatctccatggcctgcccctttacatcaactcagaggatgctgctgacattatatatttgcatgcttactatgttaaaaatgtactgtcaggaaaccagaggctctcaaattatcttaaccacttatatcaggatcagctgaaatgctagttaaaaatgaagatttctgggactctaccccttactggctaatacaaaattgcaaaattgtggagctgagcctagaaagctgaatttctaggcagcctgtgggttattcttatgaagagtctgaggatctccagcctctacagaacgtcacttcttccacgtccatttctgccactgatgctgaataggcagaatccctccttactaccaccacctgtaacatgtgcttgtcacatgagttaaaaataaagccccctgttgtaagtcgcaagtcagacccacagaatttagatcccaatcagggaacgtgacgcttggtacgtttatgttcttatgacaaaaaagggaataactaaaacaggaagttgaaaatcaaactttgactttcctatatggaaccatgcgccaaattctgaccctctctgtcactctctgctcgtgtgcgttagtcataggaggtcatggaaaatcatcctcattcctcattatgagaggctgctcatcagtcattacccctacaccctggcggggaggcaaagtaggtgaccacgcatgcaaattcagggaagtttggctcagagagttcacatcccctcctaacacaagagacagagacaccaaaggtttggaatccagtaggggtgggagatgctttgcccagggctgtctagtatggagttaagaatatgttttttgggggtgagtgttcaaggtagatgatgcttccttccctgttctggaggttgggtcctcttccataaggtgttgtcctttggtacagctttgttgtaccatatagatggtaccttctgggcctggacaatcacttgaccaaagggatgggagctcttgctctgaagagatcctgacaagagaatataggtgtggcagagcccattcctactccctgcacaccctgctggcagtaggtagacatttacccctttatcggtgttcttatatggcaccagactgtgagctcctaaggggatggggccttggcatttttatttctagatagagtcttgcctcacaaaaggacagagatacagtctaagaaatgtgtcattaggcgattttgttgtgtgaatatcacagagtgtacttacacaaacctagatggtacagcctactacacacctagactatatggtataacctcttgcccctaggctataatcccgtacaacatgtgactgtactgaatactgcaggcaactgtaacatgatggtaatgatgtgtatatttaaacatatgcaagcatagaaaaatatagtaaaaatatgatattataatcttacagggccaccgttgtgtagacagttcatcgttgagtgaaacttcattatgtagcacgtgattgttctcataaatgaacatgaaatgattgggccaccttatatagaaatgcagggtttccactgtgtaactctagagggcaccactcacatgttgatatcatagaattgaatatttactataacaatattatgacagttggctataaagtgccttgtactaaaaaaaaaaaaaggccagcatttctaataactttctaactgatgggaataaaatcagaacaggcagcctgttgctaatccactccaaggagccacaagttgttaaagcaaagagcacagccagatcaggaaatccattaaggcaagctacaagccgggtctttatcaggagggcaatatggagtcaccatggatgatttcaagcaggggagtgacacgatcagattgacctcctaaaatagttgcttctggctgccaactggagcatggattattggcacagccactcaagtggtttccttcaagaattgttagacactcatcatctctcaactgcaggagatttgagagaagttaatagatttaaggcatctttgggaggtagagttaatagattttggtggtttattgtaggcagagtgagagagtcattgtgaaggtttcttgttttggtgtctattggtaggtgtctctactaatgagtggtggttctattgatgggtggtgattctattcactgacataagcaatgctggaaaagaaagtggtagtttgggagcagagagtgtggaaatcataagctctgcttttgcctatgttgaattttgaggtgtatgtgagcatccaggtaaaggatttcagtgggcagttacatatgcagatatggagtgcaggagagaaatttggaatggagatataaatttcagagttttcagcacaaagaagatgaacttatgaggtgaatgaaatgaagagagaggttagtttaagagaggagatggcccaggagagagagatatttgagaggcaggcagaagatgaaaagccttctatggaggtttagaaggagaggcctggagaggcagaaggaaaatcaggagaagtggaatcatggaagtctatataagagggctttagggcgagagccagcagtgtcggatgctaacagtagatcaagtccagaaaagtttgaaaagtgtccactggatctaggagctaaaaactccagagtgccttcagaagagtgattgtgcaaaagtgaagatgaagggtcttcaggagtgagtggaaagtgagaacacagagacagtgagtagggagaattattttaataactttggctgtgaaggggaggagaaagagaagggtgtagctagagggagtcatggggctaaggaaagaaactgtcaagatgtggcaggtttaaacaagtgtgaaagctgataggaaggaaggagccagtgaaggacaggttggaaaaaacagggcgaggttacagtatgagtacatgcatgagctctcga

SEQ ID NO: 1108 - DNA, 36124 bp, Homo sapiens
gtgttgttacaactgataagaatatctaaggatgtttcaaaaggaagaaaaatgatccctaaagtctggtatattagtttcttattagttgctctaagaaattactgcaaacttagtggctttaaaaaacacgaaattatctttcagttctgtaggtcagaaatttaacctcctgatttctggtcagaagtcttactgggctaaaatcagggtatcagcagggctgctggaggctctggagatgatgtttctctaatttctagaggcatttgcattccttagctagtggcttcttcccacatcttcaaagctaacagtggcagtcgagtccttctcttatcttttttttttggggggggttataaattttttttattattattatactttaagttttagggtacatgtgcacaacgtgcaggtttgttacatatgtatacatgtgccacattggtgtgctgcacccattaactcatcatttagcattaggtatatctcctaatgctatccgtcccccctcccccaccccacaacagtccccagtgtgcgatgttccccttcccttctcttatcttatcactctgacctcttctgcctcctttctctacttttaaggacccttgtgattagattgggtccacctaaataatccaggataatctctttattttaaggttagctgattagcaacctcaattccatctgtaaccttaatttcttttttgccatgtaacctaacatagtcacaggcccaagggaataataggatgtgggaattgcgggtggtggagtaggggcattattctgcttaccacaggggaccttggatgtcagtaaaaaatggtgaggaagaaaacaggaaacgtagaataatctaaacaaatctttgaaaaataagtcgaaatgtggggttagaaaaagggcagaactaaaatgttaagacaaattaaaatgttaagcctataagttgagagggagatgatcaaggttaaaaatactcataaatcatatttttttgggtagggggttagatatttattaattttagaccctgagaagtaaaatagtcatgacaaaaatttaatagtaaccactaaaacaagagaaacagagtatataacttctaaatcaatatgggaaggggaatggaataagaaaacaatagcaaccaccaacaccccacccaaaataaataataaggtgagagagaaaaagaagcattgaaaaggggctaaaataaaataaaaaattaagtcatgcccgtaatcccagcactttgagaggccaagatgggtggatcacctgaggtcaggagttcgagaccagcctgaccaacatggggaaaccccatctctactaaaaattcaaaattagctgggtgtgggggtgcatgcctgtaatcccagctactctggaggctgaggcaggagaatcgcttgaacccaggaggcagaggttgtggtgagcagagattgtgccattgcattccagcctgggcagcaagagcgaaacgccatctaaaaaaaaaaaaaaaaaaattaagatagtaaaacaaatccaaatacattaaagattacaaaaaatgaaaatgaactaaacttcctagttgaaagacatattgtcagattggattttaaaatctggcaatgatatttccaggacacagtcctaaaatattaaacacagaaaagttgaaagtaaagggatggaagaacacagtcaaactaactagaagagagctgggttcacccttttatatcagagcagaatttcactgagaaaacactaacaggaagggggaaaggcacaacatagtgatgaagcacttaattctcaacaaatgtatgacacttctaaactattatgactgcaaaaaaaaaaaaaacctcagcatatataaaattttggaagagccatggctatcagctgacatgcacttaccatatttgcattgtcctactacaaactttacccatatgaccaaggtgctgtcttcatccccattttacagatggggaaatttccccatagagaaaaagatttgggccatgccttggtttcttcttgactctgcttcctgctgattgatcctcacacctcacctggagacctacttcacattatccatcaggatgagaactggtgtgcctttaccaaaggaccacagtcaccttcaaaacgtgtttagatagatctggatggagacttatgtggttgcagatgaaaaaaaagtccccatggtatatctgactccatgtcattcactgcatgaacactcacacacatgcacacgtacacaggcaaacacaatcctgttctggtccggcagtagtgccaacactcaaatcccaggtcctactctgaagcctttgaggaaaccattgtcattctggggtttatgggaatatttcttcttggtgccccttgttcctcacagaagctttttttctgtgctgtgggcttgctatcctagctttccaagctatcctagttttgcaaatttctctgatcaatcacatcaggttcttggatcatcccaaaattaaagaggtacgttttgctgcaagagacaaagacattcacctctcacacagtttgaattcctgggtagaaacagatttcaatgctggccagcctctgtagctcccagtgccccctcaattatgactcccgaggcattggagcaggatcctcaccttgcgcaaagataattaggtgtgctgaagaaagccagacactgctctttcttagctctgcatccttaaaaagttaccactactccttctctttgaacctttgacttgtcaatggtaaagtgcctatgattcttaaagggataaaaacgcaacctatataaagcacctggcatagtgcctggcacaggtgggtgtttaacaaatgttaactcctttctatcccactgtgggtgtccatatcctcttgggtaggctgcctctggtttccattgtgtcatcagagccatactaaatcgatgtgttggacatggatcccaagaactaatttctggaatgagttatgcctaccaacttccctgatacttacttctgtctctccatttatcaaatggaaatgtttgcatttggcctctgccagttggagtaaccaaaaggcttagaggttttggagaggtcctacactgccatctgtttgaccacatactgcctttcacgtgtaataagcattgtttcttacatttgtctaggaattagcagttcacaaagcacattcgcatataagggcttgttttgaattgatcttggcagcaattctatgagacaagtaaaaggtaggtcaagcattataatcctcattttaaatctgggaaaactgaatctcaaaaaggttgaaagacttgtctaggggacagtgtgtgggtaaatgagaagttaagatttgctgaactggcatttcctgactacatatctagtgtttatttatggagaaggcactacggtggccaagtggctcagagtcacacagctctgtgcctcagtttatttgtctgtaaaatgaagataataatatattctgaatactgttgtggaatttcattgagatagttcacataatggcatggatactgtagtacaccgcctagattcacaaccccacgactatccatgagaatggcccatagctcaagaggtcacattctttccccaggtgaagcccgcatccaatgactgctcagtgtgggtatataaaggcctggctcccttgccagtgccaccctacctcctggcgaatggactgaggcttgcattatgactgcattgcagctcaactgttctttccattcagtctttcctttacactcacacaggtgaggacccagccattaaatgcctcacatgataacctctattgcatgctaggcttcgtgtgcacacacaaaaaccatcctctatcagtcaggtcccttacttgcagaggcaaagaggccagtctgggttagatgtgcaccctgtttttacaacagaacgagacaaacaggtcctccttaggtgtaagttcatggccttggccccacccctgaaactcagccatctgagacagttttaggcctgaggcaaccccagactttgggttgttgtttgctgggcacagcctccttttgccaatgttgcaatcctttgtaagagaccacaggttgatcacccgttcctgttactgagcacagagaggtttgtaggccagtctctccaggaattctgacgcactgcaaaatcccatggtctgaatgcttctaccttccctgtgaaagcccctggcctcagaaaaggaagctggtttaagtgaccaacatttggggcggagcttccgagggcccagccaccgtgttacatgcaacactcaacagagatattctttggctagagttgtttttctgggtataggaccctataattaaaatcagctctccaacttcccttcctccaaaaagtatacaatgtaaggaggaaaatgcaaattgaaaagttgctagtccttcccgccagaatgccacctcaagcctcccctgcaggaagttctggagtccccaactctgccccaagcctgaggcccttgataaggtaaagggatgtgagtgtggaggccggagcccccctcgccctgtaggctgctccccttgcttttccctttgaatgttacagtttagttctgtgacttacttataattgcctgaattccccgcccacgctttctcttactttggggcttctcaccgttcctcttcctccatcttcctcctctgaccccactcccaagcctgaatggggtgttcctcttccgtgctcccacaaaaccctgtgcctctttcatcgttgcatatattatgctgtaatgtagttttctggaggtgtgaagactatgaatcctatgaagacaaatacacacctaccttgctgaccgttgtatcctcagaatctaatactgcacttggcacacagtggttgggagtaaatattcatgaggcaaacacacaggaaggactcttttgttatggttgtttgttgttgttgcaagtaacataaccccaccttgatctagctgactgacggctctaccaccttgtcttttgcagcacaagaggaataggaactgcacctcttccttcagtttcagcttgaataatatcaggaagattcgtatcggtctgagttgggtcacgtacccgacgtgctatagctgaggatggggtaagctgattggagtttgcaacactgttcacatagccaagatatggaaagaacctaaatgtcaactggtggatgaatggataaagaaattgtggtatatacatacactggaatattattcaaccttaaaaagaaggaaatcctaacatttgtgacaacatggatggacctggagggaattatgctgagtgaaataagacagacacaaaaagacatttcttgcaggagctcacttatatgtggaatctaaaatagtcaagcttaaagaagagagtagactactggttgtcaggagcaggagaaaagtggaaatgaagaggtgatagttaaagggtacaaagtttcagttatacaagataaataagttctggaggtttactattaatatatcacatagtacctataagtaacaatactgtattgtatacttaaaattgctaagagggtatatcttatatgttcttaccaataataataataatggtaataattaaggggcaggaggacacttcaaaaggtgatggatatgtttatggccttgatggtggtgatggtttcatgagagtatacttatccccaaactaattgagatgtaaatattaaatatgtacagctttttgtatgtcaatcgtacctcagtaaagtagtttaaaaatggttggactgagaaaaggaggagctgctcagcaacatgaggctgggtgctgggcagacaaaacctcacacatgcattactgaacccacggactcatgtctgtgagctttgtggctgtggatgcaccatgccaatgtagtcaaggattcttcaatgtgtaccttactggattagttccctctgtttatttgtattgactcctcagttcccttatgggttgcttgttggctcttgtggaattatttaagtaaggctttggttgcaggagtcagacatgcttaagctggttttggctgtaatggggaatttgtgagatgtgacacagtgacaggaagtgcagccagacgttgtgagaggcagtaactgggaataggaaagttatgagaagttaaggcagtagtaattgtttctctatcgaaggccataatgttatcattcctgcctctatctgtttgcttgttcttctctctcagcagaatggtcttctctgcttctctgtgcacctgcagaaggtgaccaccctaaggcttatggattcaggagtcctcagtttgagagcagttaccaaatgcctcgcccctgtgaactctagtcccagtttcttattcctggtactggcttagtttgaggcagctgcccaccgttaagtccagtgagccatggcctggggacaaggtcaggtacatgtgtaatcagctgggtctgtgagttgtggtggtggcgatggaggtagctcccagaaaaatggattacaggttaagaagagtctatatatcttgaccacatttgatgtgacttggaagtttcaatgtgtgaccacttacaaagttatgatcaggtgtctcatttatttatggtgatgtatgagtccgtgtgtgagtgtgtgtgtgtctgtgtttgtgtgtgtgtgtgagagagagagagagaatgagaatatgagtggtggtttcccatttatttttctatgggccaaatcctgggctatgagctggagatataagagtaaacaaaatagacacggtgcttgctgtgacctgccctgggagacagatattacacggaggatcacataaatgcagagtctgagctgaggtcttaagggtgaggataagtaactagtcagtggagcaggggagggaagggtgttccatgcctgtgtcaaggtcctgaggtgagagaaagaggtgaatttgaggaaccaaaaggagttcagggaacaagaggggctgtttcacaagctgagtctggaagctgagcaggctgagcagattcttaggaactctgcaaaaacttaagggcttgtctatgaccgtaaacaactacggtcgtagataaacaagttggcaaacaactcaaggatttacagtcatcagaattgtaaaactgatcccatgtattttcaaacctcaaatcccttgctctgaccttgtgtgtctaagctagaaggaagcaggatgcacctctcccctggctggaatgaagggattcacccaagctctcagtcttctcacggcatccagggcccccctgcttgtgtgtggtctagatttccattcccatagtaggaattcctttgggagccttggggtctctcctgctagagggcttcacctgtgactgtctcaattcaagggaggggttctaataacattaaacctcaatatcttgctcctccattcctgatgcctccctttccttctacccttcccctacctccttctttcctatgccacaggctggcaggttagtgccagagcaagtggccagtcaccatcattggggttgtggatcctcagggttcttcagaagccccttcaccatgatcaagagtctccagtcactcagaattccacggttcccaaatgccagctctcccactactcccagcgttctccatctctgggatgttgggctccaggcttctcagatgcactgagtaccctaggctaagccactgatccatcagaacttcatagcctgagaggagagggagacaggcttgcaaaggagagttctgactagacactggggtgctacagatgcccgtaagttgtccctttaccctcgatgtccccagtgttgggaccacctgggaatgcccagccttgtgtgctgattgacttgtagtcccctggccctgactggaagcctagttttctctctcatgaccagctaggcccctagctccccagggaagaaatccaatctatttcctctgatagtaatggctaatacttaaataatgccaaccacatgccaagcactttacagttgttagcccagtcttcacaagcaccttgtgaggtgggcaagagtcttatcttactctcattttatagatgtggcccaggatcccacagctatagttcatggtgctgggatttgaacctctggccaccagagcccaccttaatgtgtcctcctcctgttgtcataacagaaaagtacaacaccatgatgacacatcaggctatcctggcaggttcccaggctgccccaatgcccaactttctaggtttacaaagttgacatttacgaagtttccaggtttacaaatctagtttctgattctttagtcagcaggaatttctctacaaaagctgcttcgaaaatttccagccaaaccttacacaccttggcattacatcttggtgagccaaggcggaagagaacaggaagtgaaggccccatgggaagtccctgcggtcgggagcacccaggcggggcggggggtggggggctttcctgtggccggctccctgcccctcccacccccattcaggccctgtgagttgaatgaagagaccctgggaatgagtccaggtctgcagggttagaggaaattgaaggcccttaccagatccctgttgagaagtttatgaattatgagcccttctgcaaatgagagggttcttccctgtcaggagggacagattgtaggtggcaagattggtggcagccagtaggctggtctgctccttcctctctatttcatatgtgtatgaaggcattacctgcagcaagggcctgtgtaaatgcatgtgatttacagagcattttatgtactgcgtgtcattcatgcttccggtgagccctaagtctaagatagggcagatagcatcaggtccattttgcagctgtcaaaatgaggtctgaagggcagaagtggtgtgcccacacacacacaactggttggctgcagacctggggactagacccgggacttcgtcctgcccaggggtctcttgccactgctccccatcaacttggatggctttaagcatttgtgagttgtctgctccctgatggcagaatgcagagacatgaagctacaagcaggttcgctcccaacggcaaaaaggaggaggggtgttcagaacatcaggtgcttctagagaaagcagggagagagtatctggccttgtggacaatgtcacggcagaggccaggtatagggcatgggggtaactggaagcgggatggaccctgttattccctaagacatggcttccacgtagtgctcaaacaaggcctttgcccttgctgttccctccacctggaatattcttccccttccttgacattgctcaggtctccactcttatgtcaccctctcagagagggcttccctggccactttccctaaaatagccacccactcctaggtccctcaaaagcatatcctgctttggattttccctatagcaatatgccctatgaagttattttatttgctaacttgtttcttgtctgttttcctttgttagagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaaggcccagctcagttctctgcatgtgacctcccatcttacgcagataagaaccagtttggtttctgctagcctgagtcaccctcctggaaactgggcctgcttggcatcaagtcagccatcagccggcccatctcctcatgctggccaaccctctgtgagtgtgtgggaggggaggctgggctcctccttgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttaggtaagctccttccactctcattttttcacctgagaaatgagagaggaaaatgtctacaattggtgtttatcaaatgctttcaggctctggtgagcaagcgtccaggaaaatgtcaagcgcatggagctccaggcctgtctgggggatctgggcacggggaggcatccatgggagaccatgcaggcactctgaggcaggggctgcaagcctagtgcctgctggggcagcaggtgaacagagaggtgtaactgctgtgacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacagtcagttccaccagttgtcacaagagaatgcaggctcaggtggccagaacttctcgcttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctcttaatgggtcatggacacgttacaagctaggcgccttgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctatgggggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactcggactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattatttttaggatccaagtttgaaaacaattttaggctactagatatgaacaacatcttgattatgtagttgaaggaaattaaagatgaatggtttaattaaaaattaatcagaatgaaaacgattgattactaatatatctgcaatggtttattttcctgagtggcagactcactaaggtttttgaatactcctgtgtgattgctctatgtatgtatgtatgtatgtatgtatgcatgtatctatctatctgttgtctaataaaatggatcacatctctgctaataaaaacactacactggcagggtacaattataatcattaactgtgcctggaatttgcagcagcagccaccagaggtaccagtgccctttaagggttcataatttagaataatccaattatctgagtttttcagggactgaggggtttggcaaggtgtagaactttcagtaataaagtcaagaaagtcctggacaaaccaaggtagttggtcactctagtccataaccaggtaaagagctttccctgtaacctgtgtaaggttttagaatcatttctttccttattaccaaaaatcctccccaaattttcaagaaattatgaactaaatagttactctatgagataggagttcagcccaaaagaaacaccataagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcttcttcttcttcttcctcttcttcttcttcctcctcctcctcctcctcttcttcttcttcttcttcctcttcctcttcctcttcttcctcttcctcttattcttcttcatcgtcttcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacaggtaagcaacacagttgtccccttccccatggtgtctgttcttctccatttcctcctgtctgcagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacagtaagttaaccatgtagatctgagaggagagtagcttcttgtagataacagttggattatataccatgtcctgatccccttcatcatccaggagagcagaggtggtcaccctgatagcagcaagcctgggggctgcagcttggtgggtagaggtactcaggggtacagatgtctccaaacctgtcctgctgccttagggagcttctaataagttgatggatttggttaaaattaacttggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaagctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcgggctggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcgggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaaaagctagacaaaacatatttccaaaagatctctttggaggcatcagagaatggccaaggctgtaaggaactgcctgagcccagagaggtggagcccagcactggtgccctttactcctggggacatgtgctggtttcaaaaacttcagctgagtttttgagcattcatggaacttggtgggggagatgaaatttgtaccttaaatcctgcctacagggagggtccctgataatccccacccaatttggaaatctgggtcagccttcacaggtactgaagccctcctctgaatgatctcaagtcctgctagggtagaggttacctgcttttgaaaggctcctggcctacctgtgcagcaggagcaaaagtgaaccatctcagggtacagataacaatcatccagagccttgaatgacctctactgtgcttaatatatagtattcagcagtcagtaaaaaggatttaggcacatgcaagatgacctgtgtatcagggagaaataggcaataaattgagatccagcagggatttgaatcatggatttgaatcaggggcagccttcgaaagaactgtggagaatatactcagatttaaaacataagattggaatttttggcagagaactaacaactgtacaaaaaaggaaccaaatggaaatcctagaactgaaagatgcaattaaccgatgttgagaaatagccaacatctattgaacacttcccatgtggacagctgtgctaaacactttacaggcatcaacataagatgtgtccccttacagcagtgcagtgtccctcctaagacatggacagcctggtttccctatctctctgcttcatcaaaacccctttacgtggggcttagacactcctgttgtctctagtgtctagtagcacagggctcagcacatggaagccactagatacaatttgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagagggagagagcttcccttgtcccctttcttcctctccctaagccacagtgattgacagccccccccctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctctgcacattgtgtggggtaatgacacagggggattcagacctagactccataactcctgccccagggaccacccccaccctcaccctgtgcatgtcgacaaaggacagactgggccacttctcaggacacagcggggaaatgacacagagcagggaggttccaggagccccgagcgtcttttctccaggagaatactctctgaattcagactggggtcagagaaacatttacccaggagccgcagtgtgggtggggctttttacttgaaacgctgtctgaaggcagtggccaggatggaactctccaccctaccttggcaagccacttctcttctgcaatctgtaaggacattgttgagagaattatggtcttccaattccggagggttgaagaaagacaaataggagagaacctatcatagtcaggtgctagctgccttctctttcagagagtgtgagaataaagtgatacacttgattattagcaaatactttggaaattttaaacgctaatattcaacacactctggaagaggcaaataagtagacaggttcatatacatcatctccttcagctagtcctcacaaaaacaaacaaatgaataaacaaaattcttctttggccctcataggaagacactgtttcttgaacgtgtttcaaaaaggatgggtgactcactcaaggtcacactgtttatgaggacagtacaggaatacagacatgccattttgcctgaaaaaatccatcacccagggaggtgacacaattttgcagaaatgttctatttcctctgaaggatacattctttaaacctttgggaaattcattcatagtcttcctcctttgaaggattaactctctggacacaaagtgtttgattctgatttgttggttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttgaaacacgtttgagaaatagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgtgtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcaggtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacatgtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggatctcaaatcaccccaaaacccagtggcttgaaacaaccaaaattttttcttatgattctgtgggttgaccaggattagctgggtagttctgttccatgtggtggaacatgctggggtcactttggaagctgcattcagcagagtgcctggcttgcgctgggcatccaaggtggtccctcatcctccaggctctctttccatgtgatctctcagtgtttaagagttagttggagcttccttacagcatggcggctgacttccaaaagggattattccaaaaagagcctcaacatgcaggcgcttattatgacttctgcttgcatcatcctattggccaaagccagtcacgtggctaagtctagccccctgtgagaggagactgcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaagcttaacctcaatgtgagtggccatactgtggcactgtcccatccctcaccagggacactgttctggagggtgactgcctgttctgtgaggagtggggatggctaggacattgcatggaacacaccaccaccccatcttctcagagctcaaaccctgacagaacaccagctccacaggccttggcttctgctgatggtgccgtgtatttaccagacttagtggtccaaggccagagtggccagatttcccaaagtcaaggtgtgacagtgggacagcctctttgtgtctttgctgtcctaagaaacctgggccaggccaggcgcagtggctcacgcctgtaatcccagcactttgagaagccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggcgacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctatattgttgactatgtccttggccttgacaggctttgggtatagagtgctgaggaaactgaaagaccaatgtgtctttcttaccccagaggctggcgcctggcctcttctctgagagttcttttcttccttcagcctcactctccctggataacatgagagcaaatctctctgcaaaaaagatatggggcagcactgtccacaacagcctctgctggaaacaacccaagcacccatcacagaatgaattagtacatcatgtatctgcacacaacacagtgctccttggcaaagaaaatgaatgaattacagccagctgcacctcacaagacagataatcttacaaacatcatgtgggtacaagaatcacaaaagcatgcatagagtgtgattccatttctacaaagttcaaaacgggcaacatggggctgttgtgtggagggctgtggaaacaggtggtgcagagagaagcaaggccatgctctgtctgaaggcccagtgacacttggcccctgcgagagagagtggcaggcaggagcacctgggggattttagggtccagacaacattctatttcttggcatggatgcagttaggcggttttctgtatgtatattttatttcacaatacctagaaaataaaaagacttgccccccaacaaccagggtgtaaagaaaggagcatctgggaaattatgagattagtgaatggagtattgaatttgtccccataggtgggagtgcaagaccatgagtgaccacttatcaaacacacctcagtaaacagtcaggagagtgaggagtgtggtcctttcacctgcccaggttgtttctgttagattctgggcttggtctctggagtccaagaggcaggccccagtgaggtcatgcacttgctgtctgattttggccaagtcacctccctttgtggggactgttcctcatttgtttgaggggaatgttgatttggatggggattttccaaacagagctccttggacccttccctctaaggtctctggaaatgggaaaccctgcagaggggaggataaatgggccaggattcatcccttgaaccctgttcccaacagagccctctgtttttctcttctttacaacttggacctcccatgggactttgtttgaaagggagacttcattgctaaaagcaaactaaactaaataggctaaaaggcaacaaactggagaaaatgtttaaggtcttctctagatctaagatcctatgacgttgaggaggtcatccaacatctctgagttttctctttcttgtatataaaatggaagtagctggcagggcagggcatgtgtcgttgatatatttttaatcctggtaaaaggaggaggttcaaggcagaaaactcatcaaagcttaatgacaacaatagcagctaacatttgtgaggctctaaggtaaaacccaaggctaagactcttcatgcaaactaggtcaagcagcaagctacaggttagaaacaggcaaggcagcaaaacagtcacatgggtgaactctgggactctgcagtcacactctgactctcctgcttgcactgggtgctcataagcaagctagttaacacctcagagccttggttttcccaccactaaatgcaaataataggcaatgctgagttattgcaaagttacttaatctttgcaatagccttctgtggtgagtggcatattcttattattattattagtcctagaagagtcagtgctcaaaggaatctgctttagagccttattgctccaagtgtggttcatgcatcagcaacatcagcatacttctggagttaaaatgcagattctcagatctcaggcttgacttactgacttagggtcatcatcttaaccagatctcccatgcacattaaatttgagaagcactgttttaaaatgcattagccgggtgcagtagttcatgcttgtaatctcagcactttgggaggccgaggcaggtggatcacatgaggtcaggagttcgagatcagcctgaccaacatggtgaaacctcatctctattaaaaatataaaattagctgggcatggtggcgcatacctgtaatcctagctactcaggaggctgaggcaggagaatcacttgaacctgggaggtggaggttgcagtgagccgagatcacaccattgcactccaacctgggcaacaagagcaaaactctgtctcaaaataaagaaagaaataagataaaataaaaagcataaatcgcacaatgcataagttttggcatacgcactagcataaagggattctcctacttataaacctagcccatctccttactctctatcacactagcccattgatgacaccaaaaactcccctcttaacactttagctgggcatggtggttcacgcctgtaatcccagcactttgggaggctgaggtgggcagagcacttgaggccaggagttcaagaccagcctgaccaacatggcaaaaccctgtctctactgaaaatgccaaaaaattagccaggcatggtggtacatgcctgtaatcccagctacttgggaggctgaggcatgagaatcactcaaacctggaaggtgacagttgcggtgagctgagatcatgccactgcatcccagcctgggtgatagtgagaccctgtctcaaacaaacaaaaaaacaaaacacttccttactttggtttaaagtgttccataaaatattcctaagaggaaaaactttaaatcatcatcgtgctgctagaatgtcagctcaacccatgcagatatttttgtctgttttgttctacagtgtatctcaagtgccaaggccattgcttgcgatatactgggtgctaagtgaatatctggccagtgaataaatgaattggccactgatatatcaatatggattaatttattcgacaggtcagcaaatttgagaagactggggacttggatcaggaatattttgaaggaagcttagaagagggaaaaggcccagagtgaaggatttttcagatatttggaggttaagaaaaaagatatgaccacgaggtggcggtagcacacataggctttcgggttgatgctttaacaggtttacactggggaaggtcctttatagcaggaattggtcaaggaggctatagtgtggagatggggtcctactcagaggggaaggagggcaagaggactcctaggaaagaagagaattggaaagggggcttacatggccaggtgaagtcacccagcagcacagcagggaatctctgggtcagagagctcctatgggctgcagtggcttgaggcctttatggcttggggcttatccttggccagcagatattggatacagtttcatggagtatacagagcaggcaggttctaaatggattaccataggcttattggggctatgtttaaagcaagtggatgtgcaaacatttgagtttggcttggtggggtattccaggtctggtctcagcctgcggtgaggaaattaataatcaaggggccagcactttatatagcacaaggcaggggccatggattaggaaagccaggcctggggttcatgcttaagtgaggcttttgttcaactgggaggcggtgcacaggtgactgggaggtggaggggctgagatgggagagaaaagcacagagagggaagacaagcaagcctcaagaggattgtggcttcttccgtcacttctgggcctgatctactacaacactacagaatcaaggacaactgtttgaaaattcaaggctgaattcaggtctttcattggtgagtcagagttttcctacagactccctggggggcccttggccaagcaacctctcctccctaggcctcagttttcataaaaggagggaattgaactagatatgtgtcttcatcaggctgacctgcaggagctttttaccaaaagtggcctacctcctccatccagaggttctgattcacttgatctgggtgtgggacaaggacatcatgatgccagggctgaggccctgtggaccacatagctcctaagtcagggaccctgaggtcaagtcctcccagctctcccacctggccctggtagtgtctgtcaatacaatggagggagatggtctttaacttcaaagaaaggccacttaccgcatcagcagtacattttgactacatgttaatttgggttgaaggtagaagattttctattttctcaatcacaggctggctaaaacacatttcaagcttcattctggggggaacataaattggccttcaacagggggtgtcaaattggggtaaaattcttgcaaatcttggggaaaccaaataagtttttgttttctcttcacataactatgaaatccctagccacaacagcaaatctcaacatgcttgatattcagcccagttctctccataaaagtttctggagacaatgaaactcatctattgggttcttagctttaaacctgagaaagcttaaaaacagggaagattagctttgacgtcttgcctctgggtctccttcatgtggagctaaaagagtagttcaggaaatatccaccaggggtcagcattttgtacacacctgactgctctggaaagtgtttttgtttttttttttttaaatagaaacggggtttcaccattttgcccaggctggtgtccaactcccagactcaagcaatccgcccgcctcagcctcccaaagttctagcattaccgtgtgagccaccacacccggcctggaaagaatcttgacaaggcaaataatcagtttggttcatgctctcaaattagtgaaggtctggtttttcaagactctctaggtgtttcactctaaggaaaaatttattttcattcacctatcaatcaagctgaggtggggcctgactcctgacaagtatccaaatgttgcctattgccaatgtctagtctccaaggggtgacacccgagaaattctaagtcttctgtgcctgctttaaagtccacttcctgtcatcctgttatctgttgcagaccttttacctgtatgattgactggtgtgtggaattaacacttccctcctcggccgggggaacacacccacatgttggaactcagcacaggaatcccaacggcgtgcctacaagggaaatgcgtacttttgtgtgttggtgggtagtggacagaactcgtaaaagagatagataaaatacccaggcactcactacagtggggaatggatctgttcaggggccagctatgcctgcattctttcccagggacagttgacacagtcagatgactcaggaaacttgatttgcttggagtcagagcagaggaaagatcttagtgaccagggacctcaagctgccccacctgagcgctccacctccactccaaggggcttcctgccaagagatcagtatgtctgtgtgtagagtcaagacacatcttccttaggccacaatggagtcacactgacatcttcgccttccctccttggcagtatttattataagtcacaggagtttagttttctttcaactcaggcctgtggttggagcacagggagctaggctggggctagatcttgctaacctagtaggcaatggtaaggattctagtctgtcctaaagcataaataggccttggacactctgaaatttgtcctttcaccaccccatgctctacttctaagtgctctctctccccatctgcaccccctagttcctacaaaaatctcctcaaagcgaggctcttggacaatttgttccatgaagacatcgagcacggtccataccagccctcaataaccccctcttctagactccatgaggacctgtagcccagacccctgatctgcatggcgcctctggggtctttccagaggtgtatgttttaaccatcccctgagcaccttaaagtaaagattcagtgttttgctgtttgtgctccctagagcacctgggcgcttatcggaaactgatgaaaactcactgccaacatattctgaagtatattcattcatttatttaatttatttatttttttatttttccataggttaatggggtacaggaggtgtttggttacatgtagtaagctctttagtggagatttgtgagatcctggtggacccatcacccaagccgtatacactgtaccctatttgtagtcttttatctctcaccccccacccacccttccccccaagtccccaaagaccattgtatcattcttatgcctttgcatcctcatagcttagctcccacatatcagtgagaacatacaatgtttggttttccattcctgagttacttcacttagaataatagtctccaatctcatccaggtcactgcaaatgctgttaattaattcctttttatggcagagtagtattccaccttatagctatatctatcaatatatatatatatatatcatatatcatatatagatatcatatatatcacagtttctttatccactcattgattgatgagcatttgggttggttccacgattttgtgattgcaaattgtgctgctatgaacatgcgtgtgcaagtatctttttcgtgtaatgacttcttttcccagtagtgggattgctgaatcaaagggtagttctacttttagttctttatgaaatatattagtttaatatgcacttcccattttttcttctctcttagaatactgtaccccagagatacacctgacttatttcttcttccgcattgaggcctctgcacccatggctccttatcagagaggtcatttttgaccaccttatctaaaatagcatttgcctcctgaaagccacctgtacctcctttgcttactgtttctgtactttgctttatttttcttcctaaaaatggttgctgggtgggcacggtggctcacgcctgtagtcccagcactttgggaggccaagacgggcagatcgcctgaggtcgggagttcgagaccagcctgaccaacatggagaaaccccatctctactaaaaatacaaacttagccgggcgtggtgttacatgcctgtaatccgagctactcgggaggctgaggcagaatcgcttgaacctgggaggcagaggttttggtgagccgagatggcgctattgcatctggcctgggcaagaagagcgacactctgccaaaaaaaaaaaaaaaaagattaccttctgccatgctatgtgtttgtgtgcttatttaagatttttttcctactacattttaagctccattaagataagggcatttccacccacaccagtgcctgcttattaattcaacagtcttattcattgagtacctactatcgttcatctccaggtgcaggagaccatcagcagagcactccctacagtgcttagccatgaatggaaaccagctgtcagtagtagtatttttacatagctaatttatattcccagttttgtcttttttttgtgtattgtggggcaaattaggaaaataataattccactcctgaggtagaataacagggccccagggtacaaattgtgtgtctctgtgttcacccatggtgtgtgaagaaagcctgtaagtccccacgctcctccttctctctgtgagagccacaaaaccgcatagaggcaggtgtggtggaattaactgggaagaatgaacaatgttcgaaatagtgattaaaggatcatagcagagccactgaatatgagatggcactgtcaacacgccccagcctcaccacccgacagggcaggatccccaggcctggcttgctgcttatgattgttctctatctgccagcccgcaatgcccacatttctgttgctattttctgtgaaggatctcacttctcctgacctcctgccacttcaagtgcatccagggctcacctttggctctccaaacactgaccaaagttctctgctaaacacagagcccatccactccagaagggcagagctttaaaattacagttatctttaatatcaaactcttcgacagaacttgtacccctttcagaccagggcgaatctcctgacgaaagtatgcctcccccatgccccttctgagaaactcaattcagaagattgtgctgcagggagcagaggggaagggggccagctccagacagagctgattttcagataggccatttgcaagtggaaagggacaagagtctctagtttgaaatcataactctcagggatgaggtccagctacatcatttaatagccaagtgattttgaaccagcttctgaagcttcctgaagctcatttcattcatttagaaaatcaaggctgggcacagtatctcatgcctataatcccagcactttgggaggctgaggtggaaggatcgctttaggccaggagttcaagacaagcctggccaacagagcaagaccccccatctctacaaaaaagttaaaaaaattagccagctgtggaggctgaagcaggaggatcacttgagccccggaggcctggctgcagtgagccatgattgtgccactgcactccagcctgggtgacagagcaagaccttatctctaaaataaacaaaaaataaagaaaaccaagatcataatacttctcagagttattgtcattattaaataacatgcaaagtgctctgggtaaaagctcactataaaactgcttgaataaggttataacccaagtatcaccagatgtctccagcccgtgggtcatctgaatgtcctggtcctgactcagctcaccgttaagccccacactacaccctgacatgccccatgtacagattttaaatgctcagttgcataaagtttgagaaatatatacattcatttaactaccaccccaatgaaaatgtaaaacatttccataactcctgaaaattcatttatgtccttctctaatcaattcctcccactcaagaggtatccactgttctaacttttatcccataggttggttgtgtcctgtttcaaacttcacataaatggaatcatacagtatgtactattttacttggcttcttcctctcaacataatgtttttgagattaatccatgttgttgtgagaaatcaacagattgttcctttctattgttgagtagtattccaacttatgaataaatcataacagattatccatggacttttgagatgttttcagtttttgtctatgatgcgtagagcagctattcttttataccattcttcttgtggatatttgttttcaactctcttgctttgagtaaatgcctagcagtgaaaggactaggtcaaaaggtaggtcaatttacaagaaattggcgacttgttctccaagttgttgcatggttttacactgctgtgagcaaagtataagagtaccagtggcggccaggcgcagtggctcgcgcctgtaatctcagcactttgggaggccaaggtgggtggatgtcaggagttccaaatgtccaggaactcctgatgtcaggagttccagaccagcctggccaacatggtgaaacactgtctccactaaaaatacaaaaattagctgggcgtggtggcggtggtagctgtagtcccagctacttgggaggctgaggcaggagaattgctgaaacccaggaggaggaggttgcagtcagctgagatcactccattgcattccagcctgggcgacagagtgagacttggcctcaaaaaaaaaaaaaaaaaaaaaaaaaaaaaggagtgccagtggctccagttccttgtcaactcgtcaatatttggtattgtcagtattttaaattctagccattcttatgaggatgaagtagtatctctttgaggtttgaatttgtactaaaaatattgagcatcttttcatgtgtttattggtcatctgtgatttttttaaattgtaaaatgtctgtttaaccctttcagccattattttatttgagtagtttgtcattttcttattcatttatagtttttaaacaaattatttttaatttttgtgagtacatagtaggtgtatatatttatggggtacatg

SEQ ID NO: 1109 - DNA, 23582 bp, Homo sapiens
aaacaagtcttgcccatggcattcaacttcctgctctaacccccaaataccaaggccttttaacaagactggattttaatttaccaagtagctctgagatttggggaagcccatgctcaggcagcagtcacacctactctttgaatgcctccctcattgtctagacccaggacagagtgagatgatgtatattagagatctagggtgccaagctgtccctaagaagtggcgggatggggaccatctcgagagttcctgagtacagatgacagggatgacttgagaattgtttctaagagcctgcaggggatagatcacccagctcccagcagttgccaggtgccttccaacaaccaggcatggagatatcccccagcttttccaagttccatgcgggaagatcagtgacctttggtggtagaagtggcatcccgaccacttaccagtggctggctctcagacttgtctgtggctcatgaatccaactctgccatccctacctgtccaagaccagcccccagagctccctggaatagtgctggtctgccctcggtcctgacatgcatgctgcaggtctcactagcctactttcggtttcaggaaaactgattttcaaggaaagaagacatagtgctcttatgatacctttgctgaacattttcaaatagccccggcaaccctgagagcctctgccagtctgtactttgcctcttactgcttcacaaacccagtctccaaatgggttgtttgaccccaagatccaagatttcaagactcccgttagaagatgttcttgtctttcctcctttttcccagggtctcatcccattaacaggtcaatgctaaaagtgtctgcagaacccatgatgtgaatttactgaagagaaagactctccaccaggtgggctttcagccaggcaggctgtcctcagaacctcttccttccttcacaattacaagcattctcatccccaccccggctggggcagcggagcttctgccttggagggattcaactgaccattggtcaactgatcaccaactattccagctttggacctgcacctggtaacaaacaaacgaacagaacaaaacaaaactggagtaaaatagaccctccccccatggccattgtaaactcactgtgaattcatggaagagctggagttggctctaagtttcaaaataaaagcattaaaaacctcttcacattgtttctctgtcagatgcctctgcctagcttccaagaggcacctggccactgtcattcctctctctctgttcaggcctctgtgggtgttgcaggcccagagggaaaacccctccacacaggtgaggagagaaactgagccggggcagcctggcttcttttttcccagatgcctaaggtcggcagcagagggcgtagtggttgaacagggtgatgagggacagaaaccttctaggggttctcccaccctgagcagtggcacacgttggtgacttgcttcagagagtttggccctgggcttggttggggtgggcactctctgggccttatttttacatggagaacaaaacaaaacaaaacacttgatccacagtctggcttccagagtgacttcattgttctaaattttattccttactagagccgcgtggggaggccattgctattttgctgttatgtggcttgtgtccctgcagcctcttccaattctgtgcccacaacaagcattcctagtcaatcatagagccctttcttgatgagctgagtggcgcctcagagtctttctcagcacagtgccgtggcagccaccaccagccgtgcagaactgtcatacaaaatgaatctatttgccatccctggcttaaatcccagtgaaggaaatgtcctcaaatttgttcttttttctttctcttgaaaaggtcttccttggtttctccactacgctgttccccaaccaccccctgcctttgagtgatttgggccatgtctctgaaaaatctctgtcttaatagaccgaagaccaaagcaattctatggtgcaaaagagttgaaagtgttccgtctcttcggtgtgaaacctgttactggagcggagggttccatgcttgaaataaaaccctcagcatgccctcctcaatatttctccttcacagcccctgggactgcagggtcccctgggtatctctgcaagttactgttcaagctgcccaccctccagcagtgggacattcattcatttgttcagtcatcaaacatttgctgagcagatgctgacctaggtggtggggacagccatgagggactccagtggcatgtcattctggtgcattggagaggctctattgatgggagagaccagcctgcctgtctgccccagtatcactgggtctgggtgggcacggaggatgcgagtgaagagatgcttctggcacctggttcatccctgggtagacctgaagtctctgctctaacacatcctagaatgtgtttcttaagtctgcctcaactggaccatttcccggtgcgaggcatgcttgcacagtttgtttagaagtggtgctgtgtccacaaggccaactggggtcttctactgggtgctcctgatgaggctgagatgcaacaaccaccttcttcaggtgtctgagcttttcctagtttctattaatcatcatggcacctcttgatggtagaaggaggcatgcagagagaagcattgctgatccagttcacagatgaaggaactgaggctccaacatacctgagccccagctcaggactttaccaccaatcccatttgataatcttcctgaggctacacttccctgctgtccagcccagggtacatcgccagcagccatgatgatggctattttacggtgtaaaaaagacaaagttgttgggacacataagtatggcgtctgaaactgctattgaaggcctcccatcaaccacatcagaactgcccttctggacccacctcccattgctctggtccaggttccctgtgctctcatcatttcccccatcccatccagtgccaggcatacaatgggcatttaaatgttgctgaaagggttcccaagtgatcccacaagcctgctgggccagctgctgtgtgcccaacaccctccaggcttccctgcctctatgcttttctttaacctacaggacactcttacccccagcatcaccaggaacaggaatgctccctgttttcgacccagctcagatgctttaagcccttagatgttagggcttccttgcttctctctctctctcccctccagcagcatccatggtccttccaccaacgtgacccctctggcactgtgtccctccctgtgctacagtcatgtctgtgcaccctctctttctcactggcctgtgccccccttcagagccagggctgagtcttcccaatccttagattcagcatagcagcaagaatgaacagggtttagaataaaggaagcataaattaatgggcaaaaatgcaagcatgaccatgttaattgagaattgtttgtaataatgaaaattcagaaagtttctaaatgcctatcaatagaagagggggttgaacaaacagccactaaaaagaatgagatagatctcacatatattgtcatggaaatatgtcagcaacattgtaagtgcagaaatggaggggcagaataacatatatgatgttattcattttcattttaaaatatatatcgtatatgggtaattatatgggcattgaaaaacccttgaaggatacacaccaaatttaatagtggctatttctgggatgtgggattgggagaaggctttcagttccgaatttgatgttggtgatttctttgtacatcactataatgatggtgatttgatgatggtgattattgtaatgttttaatttttttacagcacacatatattgtttttataatttcttaaaataaaagcacaccttattgcagagctagggctccctgctggatacttgttttccaggctgcgggctggctcttcctcgctgcccagcctcagcccagctctgagtaacagcccctgccacaccccctccccccgccctcctccatgctgggcagacaatgcctcagcacatcttctgcaccttcactcccactcaggagcacctgggctgcaatgaatgaaactcggctttattgaagaaactcagctccagcccaaacaaatctcatgaggtagccagatctgggaggggtcagccagcaatggatctgcttcctcttagatttttctggagagggcaatcttgtggaatagttgggccaacagcttgtgagtcttcctccatcaacacattatggttctatttaaccaaatatatatatatatatatatatatatatatatatatatatatatatataaaatatatatatgtgtgtgtgtgtgtgtgtgtgtgtgagagagagagagagagagagagagagagtgtgtgtgtgtgtgtgtagtctgactgtggccagtgctgttacaggcattgggtgacaatggcagggaccctgccctcagggagcttagtatcaggcattaatttctgttgtcatggtcaggaaagtctttaaacaaatggaatcctatttttaagaaggatgaaaacaaaacagaattccaagccaagcaccagttttggtgtctgtgccttggagttggggggcttcagggttggccaatttgccttaccaggaaagatgaaaagaagaacaaaaatcattaccatacagcagcagtcctcaacagcagcccctttcactcctgaaaattattaaggacctcgaagaacaactgcttatatatttaccaacaattactggaaattcaaacagaatttcaaaaatatttatccatttaggtataataataaacccatgacattttaacataaataacattctatgaaaataacgattctttctaaaccaatataattaacgagaagacttgcgttttccgtttttgcggcgaagtctggcttaaacagagggcaattgtgttcctctgtctgcttttgcttttagtctatgggttatcacttgcattatagcctttgggaaactccaccgtatgcttgtgagaacataagattgaaaagagcagataacatcttagtgttctatgaaagtggttttgacctcgtgggtcctctttgagaactgctgccctacaggggaaaaaatacatatgtgtgtgtgtgtgtgtgtacatatacacacacacacatatatatgtgtgtatatacatatccctcgcccaaaggctgataccctgcagaaccaccacttggtggcagtagaggtcaactaaaccctccgcaggaatccgcgtctgggagtgcacgatcttggccctgtggtgagaacacctgggccccgtgacacttcttttcctgtttcctgggtctcaccatctcccttggcgttgcccttttccttctctgtggtggcaagaacttcacattagggaggccttccccttgggttccagtttcacgcaggccatcagccacctgtgctcttgcaggcagcagtgccccctgtgctcttgcaggcagcagtgccccctgagccatctgtaaaatggccacactggtctcccttacctactttgcacagcttccacaagaatcaagtgcaaaagtgtttttgtaaactgtaaagtgcaaaacataggggttagaggaaggggtggcctggtgtgatttttctggtttctgttctttgcctgccttcttctctgagtctgggttgtttgctgtttccaggaggtgaacacaggatgactacagtgttccctgggcctcatctctgcatgtgaagccctgagagctgcagatgtttggcctttggacctccaagtggacatcaattagcaagcgtgggctaggatggtgcagacactgacgtggcccttctgatgcctgggatgcctcatgagtcactgattcaagccctccaaggttctgatccccaatgcccactctgctaggctggcatcaaagagctttccaagaaatgtttggtccagctgagaagtcctgaccatgagcaccagggagccagaaaccacccagagaaacgttgcttcactcctctgtctgaggatggggaggggccagtgagctctgggctcagccactccctccagtctcaagtaacacgtccccgtgcctccagtctcctctcagcaccgaccaggtttttccccgctcctgcacccgtggatcctgaggacagcggtagcgccttcctcaccgcacgctgagtccagtgcgtgctcctcactgtgcacttattagtgtctgttgagtgattaaatcacatcctcaggtctgcagcaaataaatgaaagtttctttattttttattaactaaattgagatttttttcaagctgatgacagaaaaaaataattttgccatttcagggtaaaacttcgaaattccaagttaaatgcccagttcaagattttttccttctccaccttcccctggggttgactttagatctgggaggtttgggatttagggagaggcttcagggtcctgggaggtgctctgtcctaccctggtgttcttcctggctagtcctgggcatggctttccctccagggtggcttctgtataagcatcttcagtcccatttggtccctgtcccgtggtccgagcctgacatatgtgcccatcccaaggcctctccagccttaccatcctccaagacacatcagtgcccctctctgccctgtgtgaaaatctttggtttctccgttgaaactattcagggggctgcatcaagcccagcttcctagggccagtgggtggtcctccctataccacaccttaggtgtggtggcaagaggcattctcttttcgtgtcatctcccaggccattcaggggatacagctcatgtgcccttcactcttggttttctaccctccccaggagttctgccctctaccccgaggctctgctgggggccaggcagagagctcttctccagggaactcaatagtgtctgccatcatcctctcctctcggacttctcttccatagtccaaggagttactttctatcccagggctaggaaggttaccactggaaactctaaagccaagaattaacttctgtatcaataacctctataccaataagtgcagaaaatacatcagacacagtccaatctcattcatgataaaagtgctcaacagactgagaataaaagggaattttctcagcctgatactgagcatttatgaaaagtccacagctcacatcatattaatatttaatcgtgaatgactggatcctttcccactaaaatcaggaacaaaacaagaatgtgtactctcaccacttctattcaacattgtattggaagttctagccagaaattagccaaggaagtgaaagaaaaggcatccaagttggaaaaaaagaagtcagttacctctatttacagataatatgacacagtttaaaaagtgagggttgtgcaacctgccaatgtactaaaatatattgaattatacgcttcaaatggatgaattgtattgcatgtggtatatgaagcgtatctcaatgaagccatctgtttgctgttgttgttgttgctgctgttgttgttgtttgtttttttttaagacaggatcttgctctgttgcccaggctggagtgtagcggtgcaatcatggcttactgcaccctcgacctcctaggctcaagtgatcctcccatctcagactccgagtagctgggactacagttgcatgtcaccatacccagctaagttttgtatttttcatagagactgggtttcaccatattgaccaggctgatctcaaattcctgggctcaagtgatcagcctgcgtcagcctcccaaagtgctgggattttaggcatgagccactgtgcctagctaaagccatgtttttaaagtgataaaaataaagaatgaagacctttaggtcctctttgagtttctgctgaggccttcctttgcagagaaagggaggtcttggtctggggtcaatgaagcagagtgacaatgtgacaatgggaggagaggaattgtgaggtttgaacatcacagcatcttcctgcttcaaactgggtggatgtaaagagggagggatggatggatagatgggcaagctagctttatggctggccacatcttggcctgcagtgtgtgctttgatctggaatctgctggaaacaactctgcctggggcctggcaacctggagagggtagcaacttcactgcttgtgagcaacgtgcttctggccaagttatgcaacctcgttgggcctacttatctcatttgtgcagtgggaaaaattacatacaacaattatataaatatctcatggggttgttgtgaggatccaaccagatattctacaaaataggcttagaggactgcctggtacagagtaaacaataaatattagttctcctttctccagggtggcttcttgatgaatctcaactctcctggcacagagaagatggtaattatagcacactttactgtaagtgaaccctccttggagcttgcctgcaggaatgaacactgcaggttatgtgacttttgcagaaaagcctagggaaagcaccaagctatgctggtgattaatctgcatcagtgagtggaagctcgtctctgcccgtctcctctggcaagacattgcatttccgagttatattctgaaaccatcaccaaccatcagtatctgtccctgctgggatcctgcttgggctggtgtctccccatgccacaggtggtaaaccacatagtgtcacatgattcaactatgtctggcgccagtcattcagaaaacccacatggaggagaggagaagagaaggcccttcagctgtgatctggaactccatgtggctggctgtccaggaagctacagaaacctttatccctcctggagacacccagcccagccccacataaaatgtcttcgtaagagtgccccccacccccacctcccttgttaaatagggcatgagctagagaaaggctgttttgttaatgcagcttactaatttcttatcattattctgaaatccaaacagctgcgaaaactcaagatttgttaggactcatttggctgcaaaacctgaccatttcagtgactgttgcagaattgatatgtttaattatggaaacttgccccaggccctgctgtgggtgttatgtaatatatggcacgtggattgttttaactttctaaaaggctaaaaagcttgaattctgaaacctgactccctaggtttctggatatgagagtgtggactggaattatgatgggtctattttaccctcaggctgtggttggaagaagcacaatgcacacccttggtataaagagaataagaaaggggcagaatgcaaacagcaaagggtttggaagcagagagcacgaggggtgaatccttcttctaaatctcaccacctgtgggatcttgggaatgccatgcagactttctaagctttggtttcagtatatataaaacagaaatgcataataataatatctacttcctaccataactagtgggttaagcacttaattattaagcatttattctgcatgcccacattcttgagcagtctcccacttccaagctgctgccttctcctctttcaggcacaaggccagtttctcaggaccctagccctcttagcagtgtcagacatgccttcagcctcccctagtggcaaccctcagatggtcctcatagacattctttgtaactgctccctgcagccctcctgcagctccagccacagcctatgagcctgagggtctgtattcagcatcaggagtcttatcacagagactcctacaggagtctctgatctattcttccccttaacaacacttgtagctttctttgttctgagcagcaagaaatgaataattgccaagagaccagctcatgttgttttttccacatatgtatttatttcaaaataaagacatacaatgttaaacaaataatcacaactgatactgatttagagtagcttacttgatttttaaattgtagcaacttaaagagaaagctttttaaatttaataaataggataaataatatttcatcttcatatcttgcctctcatccctctcatcttttctttctggaaaatttccagaagactcttcagaaatgtcagcgcgttgcctgccgtggtttggttgcatggctgttcacaggaaaaatactgtggggatgaaagttgataaggacagagtgactcaaatgatgtagagccaagcagccccagaagcctacctgccaagagccagagtcggtggtgaggattgtggggatgggaagggaagtggcttgagacacagagcaaataggtgggcaggtccaggctagctcatgtggtgtaaagacagcataggtggttgacctcaaattggatttcaggggtctttacacacacacacacacacacacacacacacacacacacacacacacccctattaagtggccctaaatctctgcattagagaaagccttttctggggactctttgaggcctaaaattgtatcattatccttttaggttgtctttccaaggtcatttgacagtacaatggctaagagtggggctctgaggtcatataggcctgagttcaaatctcagctctgccacttatcaaatatgcagccttaggcaaattagttaacctcactgagagtaataaattgaataattgtccctaaggtatgtatttattcagtgagacagcatatattaagcacttagaactagatgccattgatggtagaaacgcatgcagctaaacagctgagctcagggctttcagccttctaggatcttgtgtggagatgctaatacccaaaaaacagagggaggtcacctctacccaacttgccatcccagtctgctgtcagggactagggtatatgctgaagaaaagaatgtgtggatgggcattcaggatgagtagcaagcttccaccttgacctgggtgcattgccctttaaatacctccttaatgcaggccaggcatggtggctcacacctgtcatcccagcactttgggaggtcaaggcgggcaaatcacttgagttcaggagttggagagcaacctggccaacatggtgaaaccccatctctattaaaaatacaaaaattagccaggcatggtggcacgcacctgtaatgccagctactcgggaggctgaggcaggataatcacttgaacccgggaggcagaggctgcagtgagctcagatggcaccactgcactccagcctgggcaacagagcaagactctgtctccaaaacaaaacaaaacctccttaaccaacaggaaaaaaaaatccctgttaacaacatccattcagttagtacattgaatctctaggataatttagtattatgtgagctacatccctgattctctagattgtagcttctaattacactcagaaaggattctttcattattccatagtagagagaagtaaatggcctcgtcaggaacaatgatctatctcactttaattctattgtttcagtggatctcactttaattatattacttctgattaaaattcttagatgtcttttatcaaccttgaactaccaattccaactttatcatccttttgtgttcaaacagggttggcatcaccattcacatagaaatcaccaacaggaacatatcacatatgaaaacaaacttactggacacttgttgttctttagtacttcaactgattttttcacccgactgaaaatcagtgggtatcttgtttgcatggtggtattggtcatctgagacagtctctcactgaagcatggtctggtgcagttgtcctggtaaatagtaaggatttattcaaagaaatattctgaggacagctttggaaatatatcacaaagagcaatataatagagatgatttttatttaatcaccattactcaaacttgcattatttttagacaggtcccttgccaatgtaggaagtgatctcccgtatttaaaggggatgccatttttccacagtgacatcccctggaggagacttcctgtatgttacatccaggaaacatgagggctctgggccctgaaatagtcggctctgaatgttcttttcaacgggtgcttcccggcttcaaggcttgtaagtctgaaagtgcagagtgaggaaaagccttttcacaccagctaatgggatgtgacaattgaatgcagctggtatttcagcagcagctaaaaacatggacggtactccaagggacaggggctgtgctgtctgcctggttcctgcccagaaggcactctatcctcttctcatctaatggatggaccgcgatgggtgcgatgtcttaccctagccagggcaagaagctcagattcttcagattctcccaggccttgcatgagaaagaataaagcactgcaccttggagaagtgcctcctcctcaccctaaccaggagtttgaattaggaatcagaactttcctgccacccatccttcctgccgtagtgggcagtggccctctggaagccctccttccactcacaacctcagatcctctacctgcccagagggcagcattcaaaccaacagtcactctaatcagctagacagacaacagggtggtggggaggaagggaggaggcagggagggggaggtatagcgcatagatcattcatgacagatgaaagataaggagttgtcattttatttacattgtttcacaactctagagttatcagtaaatgagttagaaagcaatatgatatgagctacagcaattattatatccttagttccagttttatttaattgtgcacatggccacctatctaaaaagatattcaggattctttttttaatgttgaaaagtgttcaaacttctcaagaggcataaagttaattaaatacaaagaaatgttcataatataggatttcaagatcgtagttttaaaagggaataatttgtaacaatgtggttttaacagggaatactaatctgtaacaattaaattaagcaacaatgtataacattaaatattaaataaagcaacttatttttacttaaaaacaaaccaaaaaaatccaaggtcaacattatgttatttcactatacttacagagggaatgcccaaacagagacaactggtcacctgcaagggaaatttcagagtgaagattccagatgtgaaaattaaaattaatttggaaagttcttaaagagcattcactcacattagcactgcagtggcacttggaagctggatcttcctaaagtagatagagagataagaacctttagtcagccccgagttttttcatcctcatacatatttcactttgtcagtagctgtctttcccatgggctccccctgcagcctacctgcatcttgttgatgaggaagttgatgtccaggatccccgccaaggttggacacccctggcctgccacggagcacaggagcagggcagaggtaaggaccatggccagaagcatcttgacagcggactggagctcgcttgcagacaccttcaaatcgagtggtatttaaagctccctctcaaacacggaaaaaccctgacatcaaactgataccaagagcccactttttctctgtaagttggggccactttatactaacaaacaaaaaaatcaaactgagtcacttgacagagatgatgctgtgccaggaaatatcattcctcagaaaagatgattttcaaaaagttgagtactgaaatgctgaaggaaaagttaaagatctaaaaaccaagaaaaaaaattcaaagacagggattctggttgtgagagttagaatactttccatgaacgcccaggtctgtattttccctttttacattatgggaaatgctgatataatatagccagtcatgggtgttctaacgaaggggggcctggggagacagagcgggttgggggagggtgcatgatattgcagaacttcacttatctctgttggggttttcctttagtaattgcaacctcagtcttactatgctttattcccaaatctcaatgtttttcatacccaggatgaagtttgccacctaatgcaaatgcatcttagaagtatccctttgtgcaagtgtctgaaagaagaaatgttcaactataagcacaagaatgcggcaaccatgcttgttaaaattggccttgaggactcctcagtatctttggagatcttatataacactgtatgacatcaagtaaaaacccagcacttgaaagagtatagtagctaacatttactgagaacttactacatactagtaacatttcttttttttttttttttttttttgagacagagtctccctctgtcaccaggctggagtgcggtggcacaatccaggttcgctgcaacctctgcctcccgggttcaagcgattctcctgcctcagcctcccgagtagctagaattacaggcaccctccaccacgcccggctaattttttgtatttttagtagagacgaggtttcactatgttggccaggctggtcttgaactcctgacctcgtgatccgcccgccttggcctcccaaagttctgggattacaggcatgagccactgggcctgaccatactagcaacatttctaagtactttacatgcattaagccatgtaatacactcggctgccaaatgaggtggggagtaatttgtcatcaccattttttaccctttaaaacactgtctacatcttagcttcctggcccttcagtatggctgtgtttaatcactatgagtcaaaaaagcaatctcagtgtaactctatgaagtactataattattcttattatcttacagatggagaaactgaggcatagagaggcaggtaatttgcccaaaaccacaaagccaggaagccgcagaatttgtattcaagcccagaagtctgcctcctgatttcagctcttaatcctcctgaactcctgtttttctgcagatcttttatctgcctctcccaccaggatatatactccagggctttatgggtccagttcacccctatattctcagcacttaaggaggtgcctggggaactgtgggcactcactaaatgcttgttgaattaaaacactaatttgaaaagtagttcttgaaatacgaacttcctacttctgggatttataagatttcaaatctgatttctaggatacatatttggaggtatgtgcaggtaagtaaatatagcttctacacagtagattgaaaaggtgaggggttctttagcttagcactctgaactataatagccagtggggacaaactcataagatttcctcgcctccactgtaagagtatggcaatactgttttttttcattttgtattgtttcttaggagtgatgatggctcgtcagtgttccactgcactatggggaagggagtgtcttggtggtaaacaaggtaaagagaaacaggtgttttgctaaattcccttaagccatcccacatctctgacttccatccctgctctttgcagacactgaagagaaaactcaaaggattcccagcctgtggcaaacacttttgttacaaagcactggatgtatgcctttttcttgatggtagaattctgattagtttggggtaccaatgtatccagccaaacacccacattttcagcctcttttgctgctacatgtagccatgcagcatgtttcgatcaatgcaaagtatgtaaaattattttgctttcctggtaataggagacaaaagtggctgaaccctgtctttccccttaattccaatttgggtgtgatggcaggagcttcagcagcaatattataactatgaagaaatggacaagagaattacagcaatggcaacactaacatttttcataaatagcaaatattcagaaaggcaataaaaaataaaaccatgagactaacaagagaagtaataataatagtacaacagtgatactaaaattctagctagctatcactgcctactgaggatcctgagttataaaacctgttcttgtttaaaaagaaaagaaaagaaaattagcatgctttggagagattttaaagatacattaccatcagactaaacctccttccctgacattattggaagacttgagagagatgtgaaaaggcaatcatcttttcattctgtgaatcaatattatctgatgctctctgtgtgaaccgtggaaatcatttcacctgccatcgggtatgcctttcatattgaggaaaacaccaccccacccctcctgttgtacagatgggggctttgcccaagaagagaaagccacagctctagtttctagcaggggatagtacagtgcagtggttaagaccggtgactctagaatcagaatgcctgagttcaagtcctgcctctatcacttgctagctccatggccttgggggattgcttggcctctcccagcttccatttcctgaccgtaagtgaggatggtgatgtggaaagtgggaatggggatctagggatgcagttgcagttgtcagttctcactcactcgtaagtgaggatggtgatgtggaaagtgggaatggggatctagggatgcagttgtcagtgaaggctcccctcagggtactcccatagagattaaaagaaacagctgctccatccctaacttggtttaagtggcatccggtttgaagtttgttagggcaaagcagccgaggttagcggtcaacaaactgtaatccacttttcaggttgaaggtaaggtctacaagctaagaacagtgtttacctttttaagggttcagagggttaaagtttataaagaaataattaacaaataaaaacaagcatgtgtgatagagaccgtatgtagcccgtaaagcctaaacatttattatctggcccctttacaggaaaagttggccaccccctggctgagttcccacaccccaccccacattttctgaagacatcaactattatcctccagtcctgggaagggtagagctaggggttggttgctcaggtgtctcttctccctttccccatctggttatttaggtcaggtatctgtacagagggaagggagcaggggacctgggccacagactgccagattatccgaagtgttgggggcctgccatttcctgaggctttttgtggagtgagctcgctggtccaatgaaccaaagatcttctctcaatgaaacccggtagctgcagcaaagatatctcaggcaggctctggtttactaggaaaagtcccacattttgaagttaggagaaaagtgaatgaattaacaagttaagtcttggcttgaccagcaggccttgggtcacccaccttccctgctaccctcaggagctggctcagggtcaagtgatccatggccactggtgttccttgggcaggttacttaccctttccatgcaccaatgcacccccagtgctcactcacttagagaaaggaatgtaagccttcacccagcccttcctcatgaaagagaggagtgctccatttgggatatactctcaggaatgaggcatgtttctgtttggaaatgtggtctggtctggtccaggtgcctcgctctttgataccccctcattactaccctcccgtcacatcagtttcttttcatttccatcctccaggcctttacccttgctaagcttggcctgctggctccttcctcagctcctccctacgtgacctgttctcatcatttagttttcagctcaactacaacctcctcagcaagaccttctctgaccatagcaatcactgccatctgcctgtgcctctttcagtgtctggttctcccaggagaatgtcagttccatgacaatggacactacaacggactctcttgctcatcactattcccagggcatagtctatacagagtgctcaggaattcctggttaaatgaataaatgactaatacatttaattttgtgaacatttattaaatttgtgttactgatgaaatgaccaacacatggttcccagtagacaggtaacaaacaaaaagcagatgtcacatttacctgaacaaggaacacatttgaaaagtgattaaccaacaagggagtaaagcctcctgcagttctgtagttccttacattggtgcagggtttgagaatttctgaagtgcttttcaaccgcttctttctttggactcttatactaactgcatgaggaaggcatgcgtggtgcaggagctcctctgcaaaggatgaaacagagagaaggagacaggtgaggtgactggttctttagaattctttcccatttccccacccactcagttataaaaaagaaaagaatacagggttgttaaacggtagctctgcagttcaaaataccattaaaacagcagatgtttatctaggcaaagtctatgacttttgaggtttaactcctaggatttctttcagtatcaaaatgtaagtatgcatataagctacagagcaaatacaccacgctcagaaatcaattactcacctattttaaatatcaagattagagtgagatgcataccaagagttatcatagataacatattttacaataaatgacaaaagacaatgatcaaccatttattttgttccaaagataaagtttgatgtttttattttgtgataaaagctcatatgtcatggattatttctctaggaataaaacaaaatggttatgtgttctaggaaggcacagcataaaatgaccaaaaaaaaaaaaaaaaggcactgcatttccaagtaaaacctgttctgccttttactccaagcagccaagaggtaactagttatgagaatcctcaagtgctaatttcctaatcaagtagttatttctagatcactactttctaagtaagcatgatggggtaagccccactggtgatgctgtccttcggttgggtcttctctccgtggaaggggaacccaggaccccttccctcacatcctgcctgagcaaaccctgtgtctgctgcccttggaagctactgttccctgtgtggccccacacagttttctctgagctccaagacctaggatctatttctttcctccttcctctcacttctctttcctcactgttgttggttaataacaatctgggctatccttgtaaatggaatttcacatcctcccattggcatagtccaccattacttgagacatgcccctgtatttctcagagactatgggactcccccaactccccaccctttgctgtggccaattcattgatgtccatctaattaagggaggatgagaactgttgttctggattacactggagccttaaggcattagaatttgttaaatcttcctgtgcacaagataacttattaagcactttatatatatcatctcactcagccccctcaacaatctttattaaccctatttgtagatatccaaatggaagctcagagaagctaggagagttgccatagacacacagctggcaacttgaatgagatttaccagaccccagagcctgtgttcttatctgcaaggccataaatcaatctccacttctgttgaccgatactctataggctgtactccaagtctacttaatacaagcagaaaatcaaagtatgcctttggggaagagggaggtggattctaggcctcagctatatctgtgtcctggggctgccatcacaaagtatacaaactgggagacttaaagccacggaaatttattctcgcacaatcttggaaccagaagtgcaaatcaaggtgttgacagggttggaagcagcctgactactgcagaagtggctgttgggaagaagtggaagatgaggctagaagttctgaacggaaggacagagccctgtgtcatcaagattgcattgaccacaaatcacaaaaccccagttaacactgactggagtgataaggaaatttgccatctcacaaaacactgcatctgtggatacggtgggtcctggggtggtcggatctgcagctctgagatcttgtggacaggctgctttgccactctgtgggttgacttccctccccttggggctataagatgactgcccagttccagggctcacgtccactcatgacaatataaatcctacatttggaatgaatggtcaagtatttgcaaccctttcactctcaatacgttttgccaaactgtcctccagaaatatgttctaacatataataatagaatttataatttataataatcccattagtcacgtttaagaatgtccacttctgacatccttatcaacactggacagtgattttttattaaccttggccgtgtgtctggcaaatttatgatgctaatacatatgtattgaattcataaattaatgaattcttgcttttttatatttcttcacttgtgagttacctgttagtgcccagatttctgttggtatattaatcttttgcttactgattactaagagttctttgtgtatctttgtttttcaaatatattacatttattttcttctgtttattgttatgcttgtagtgttttctgactgtgttttcatgtggtcaaacatataacatatttatctctatttttccagtctgtgaatgattttattttcagcaattaaatctttaatctttttagagtttatttgagggtatagaagaaatctaatttatttttcttccatgtttggttgatactattactaactaaatatctcttttacctactgatttgaaatactaccttattgaacactaaattttaatttttcttaagtatctttctggactctaatttagtccaatgagctatcttacagctctagattgaccttagaatgcaattgtggtaataaaatgattgtcgacatttccttcatattattgggaatgctttcaatgcttttcatttaaatatcatgtttgcttgcatgacctcacttataagtgggagctaaacaatgggtacacatggacataaagatggaaacactagacgccaaagactccaaataggggaggggaggagggggcaagggttgaaaaattacctattaggtacaatggtcactatttggatgatgggtacatcagaagcccagacctcaccattacacaatatattcatataacacagctgcacatgtacctcctgaatctaaaataatcatctatcaatcaatatcatgtttgctgttgatttcctaatagggaacagtttcgaatatttagttctccaaatttttattagaaatgatagctgaattttacaaacgcctttcaagtttttatcaggatcatgagttttctttccactaactcatatgatacattattttaactgattactaaatgttgagccatcctcacattcctggaataagttctatttggtcatactatattatggttttaatacgctgatggaatcaatttgttcttcctttattttgaacagaggatgaaacacaggttcccagggtggcagcattaggtgctgctcttcagtaggaatggccctcaaggtcgtccaggcaccattctctttagtgctccaggtgatgactcaggtgtggagaagcacgacttccattgggaggcccaagatatgtcctggcctaaggctttgtgccccacaggagtcaatatctggtgaaagagatcacagacagcttccaaggcccctgcactcaggagagcccaaggctgtgacactccactaaaaatggatagttcatttatagtcatcccagcccagacactttgccacccaggcctacttgatatttcatcttcatctggtgtgtaggggaacagagctaaataatgaatggaaaagccaggttctctttcagaagggaagaggctgcattaacaactttacttagatagtgtccatccctaagggagttcattcttcatattctttttatgtgccttctttttggggcacataaaaagtgagttaggaagagtttaaatagtaagagaattttcaatatttcctcactcctccatagcaaggatttttcttcttttatttccacaaagccagtgacaagacagttcccaacacatagtaattagaatttttttgtttggcagtgtcttgctctgtcacctaggctgaagtgcagtggcatgatcttggctcactgcagccttgacttccagggctcaggtgattctcccgcctcagcctcctgagtagctgggaccacaggcacgcaccaccacaacaagctaattttttaaaaattttgtatagagatggggtctccctcacatagctattgctatgttgctcaggttggtctccaacctctggcctcaagtgatcctacagcctcagcctcccaaagtgctgggattacaggcatgagttaccacacctggccataattagaatatttgctgaatcaattatgttctgacagaactcatttgtaaaatctgggaatgattacttttggaggtacatttgttggtgttttctatttcttctgttttaattactctattacattttctgcttaatatttttgtgtgcatttttgtaggaaataatcccagatttgacaaagtgtaatactgtgcattttacccatctttctctgtaataaaacttgtaagaaatttgtatatttgatttttttcagattcaagttttgcttttatttatcaattctgtgtacgatttttatcttcctaacttagcattttatgctttttcattgttaatttctacttgatttaaatttatcttatcattccttttctagctccttgagttgaatatttgcttcaccttttaaacaaatactagcttcaattatctaatacattgtatggtaggcaccaatgctgcacatcttaaatgcattatgtcactgaatcctcataataccacaccaggccatataagaggtatttatagcaaagtaattatgagtgcagacttgagaaagtctctgccacttaccattccataaccttgtgcaaatagcttctctgcattttggttttctcatttgcaaaacggcataattatataagctacaccatggggctgtggaggaagataaattaattactgcctggaaagcccctagagcagtgtctgacccacacacagcacagtggaagtagttgatattattagattggtgcaaaagtaattgctgctcttgccattaaaggtaatggtaaaaaccacaaatacttttgaaccaaactaatattattttaaaatgaggaaatggaagctttaagaagtctagtaacttgcccagcatcacatagctatagctggataaggagctgtcttttgaacacagcatggacagcactgcatagattttgttaagtagtttgctcattcttattgattccttaatagtctgtaatttcaggattaagactgtaattccgtgatattcatccttgaaattcagaaacttcaccaggatatgtctagttgtggctgttctttgattcctcctgacgagcatgcaattggcttattagatcttaagatgaca

SEQ ID NO: 1110 - DNA, 122934 bp, Homo sapiens
acaaacatccttggatatatggacactctatgaactgcagtctccctgctcctggcccttagaaataacctcttccaattctttctgctctttgttgtagctcaccaacagaagccagaccaggcacttttcagtaatcaaagtagtcctttctttcagattctagatcattgctttgtctatcttcttaattaaggtaagttcatcattcatgaggctcctcaatccagagagcaagttgactcccagggaattctctcaccaattcagagtcagaggctgttactgcatgagtatgtctcactccacagctgatcatcagcttcctgaggagagggcgcattgcacttctggttctccctcactgtgctttccatgcagtatgttggccacaataggaactcaataaatacatgctgaatggaaggaaacaggacctacctagcatgaagaaagaaccatttcttaccgcacagggttcgaaagttggctgaaggcaaaaatgaaaatgaacaccagattttccagcacatgattgaattgcatttgatggtattgtcagggaggcttctttggactaatagaaataattaaggaagacagactgcttcagacaccctaggggctacttagctctccagtgaggcattttgcttttatgtttaaatattattttcactgattataaaaagaaacatccgttctcttttatcaccttctagtcaaggcagccaaatgtgcttagatagatggaaaatgccttttaagtaagtgattacctatgaagaattagtctctcttctttcctttcctagacattgtggcattaatattggcattttgtttctttaaattgcatcctaaggtcccgttccaccacagctccttcccagacggcattactgtagaccagactttttaccctgcttgtctccttttctaaagacttttattttctttttagtttgcacttttcaaactccagccataattattggggtataatttatacatagcaaaggttatccttttcaagtcaacagttcaatgagttttgaaaaattgatatagtcatgtaaccaccaccacaatcaagatataaaatcttactatcacttctaaaagtttcctcatgccccttttgtcaacttcctctccccattcccagcctctgcaactgatctgatttctgttgctttagttttggctttttgagattgtcatatggatagagtcataaagtacatcaccttttgtatctgccttttttcatttagcattcatttgtgatcgtgattcatgcacgttgttgaatgtatcaattgttcattcctttttattactaagtagtattccatcctatggatatattttgtgattaatgtttattagtttgttttcttgtctgtaatatttgtatgtgtggtgagttggaagagattttgtttatatcatagttggatttttttcactttgtatttcctatcagacaatatggtctgctaggaagactcatgcctggtattgaacatatttacatgccttgcattgttcaggcagatatgtactcagttcctatatgctgtataaatgacctactgcatatgtgtgatgattcttcctgtagttttgaagagtgtgatcagggattttgtatctcaaattgtgcaatttaaagatgtgcagtttattatttagttataattatataattagttatacctcaatgcagctgttaaataaaaatatacaaaatcactgttaaaatcttattcttaaaagaaaaattacacatgcagcaggggtttgtggtagggctggagctgagatgtagtgatatatgtaatgtggaagtaagtagttggagaaggcagagaatggcaaagaacagaaaccaaattgcagggaaatatggagggaaaattctgagccagattcagaaatggagccaaaggtcaggaggagatagtgtttctgagtctacagtggttcctctcatatgaatgctggtgacccagctattctggatatacacaggtaccctgccagtggggcgtgggggaatgactacaggtaaataagaatgtgtaacacattggggtatacaaaagacttctttggaatccctctaagaaaatgttagtctgagggaaagcagcagtctcctcattttcagacagactcaagagcagacctggaacaataacatccagtgtcatcacaagttgttgaaatggacagggatctattccaattttgtgatggataagtacatgggccgccaaataacaggccaacagcagctaggactgatctctaagcacagcgagaaataactcaggggttgaggaacttagttcatttgtgttgctacaacaaaataccacaggctgggaatttataaagaacagaaatgtactctctcactgttcgggaggctgggaagttcaagatctagtcaccgatatctggtgagggtcttcttgctggagcctcacatgacaaaagatgcaaggacaaaaaggagtcaaccttcctctgtcaagtccttaatccattcatgagagtggagcccgcacctcaacacctccccaaagacttcacttcccaacactgttatattggggattaagtttccaacacatggatttggggggacacattcagacaatagctgggccctatatatacaagtggaacagtgagaggaggacatctgggcatttgcatggataggacctcatttgtactgagaggctggtgaggctgataattttcagtttacaaatgagtaaaagtcactacctctaggtctatgggccacaactctaagaagaaaatgggcctctatgtgtaggttacaactacaagaagaaaataaactgcattaccatgatataccatgtgaaagtttatggttttaggggcttttaaaatgttagttcctctcaagttcaagccttagaatgtcttcatttatctacacatacagagttttttgatggtgcaagccatcttccatataactgtacttttataaaggttcctgatgcatctaaagaaaatgtgcctaggctgggcatggtggctcacacctattcccagcacttcgggaagccgaggcaggcagatcatctgaagtcaggagttcgagaacagactggccaacatggcaaaaccccatgtctaataaaaatacaaaaattagtcaggtgtggtggtgtgtgcctgtagtcccagctacttggctacttgggaggaggctgaggcaggagaatcacttgaacccaggaggcggaggttgcagagagctgagatcatgccactgcactccagtttgggcaacagagtaagactccgtctcaaaaaaaaaaaaaaggtgcctaaacgttctctcattccactgagtagcataaaccagactgaacttccatttgttctgctcatatccaagcatattatttcagctagaacaagactctgaagacagtatctggtaatgagatttcaagcccattgagcatagccactgagggtagtcatgactaattctcaacactgtgcttggctcaatactttgcacattgtagatgctaaataaatatgtggtaagtgagtgaatgttacaaaaccgaagagattgcaagattctcaacttaatccaaatgacggataatgttagatataataagaatctgtgagaaaaaagagatagaaagtctggagaagaattatgcagagaactcagattctcaacttaatccaagtgaaggataatgttagaaataataagaatctgtgagaaaaagggatagaaattctggagaagaattatgcagagagcttagagacaaatattaggagaccatgaaataggccaccatttgtgagccaggaatactagctgttgctttctcatactgcacagtaggaaatgtgaaagcagaaaatatttagattgtgattaaaactgagattcctggaaaaactgaagttcaaaatctttctgggctctcccagcttcactgattccattcttttgatgggcaagcaaagttcactagtctgccagtcaaatagatgctaatggtaaaattggctctgtttgactttttgatgttacacatttgaaatgtgtttccatctaaaaggacaggctccaatctaaatggtaccaacaaaattacttcaaacaaaataggagttcatgtcactcaagatgcactaaaagttaaattgcaaaatggctgaaaaggagaggtcttggcttcagaaaagaataataactacctaaagaacaaaagttcgtgttcttggcaggaaattttaaaaaaagaaaaatcatctggtgtggtcatacagtgtatcaaactgaagaagaccctttctttactgagttaaaattaagtctatagaatcctaactggagacaagccatggaaaactaaaggcacttgcaagttgaagttacagggcaatggaaatgatgagtaattaaggaggaagtcagcctacagagaagacaatagagcaggtacacacagagaagcaaagccaacaagtcatgaattccctaaaagttgcagagagttaattaggttcttatcttcccagtctccactttaagtacccaagggctataattcctgtctttgggttctcagaaagttcttcatatccttgcaattaactattctttgacttgggctagtttaaatatgatttatttttcacccctgaaaaataactgccctctaactggaacatgcaagttttccagacagagtagagtagcagatagccataagcagccttaatccttcatatgacacatttctttaaaaaagtctaaagtatggatgaacaatgtttccccttcattgaacttttccatgtcctaagagataaaattctttttttttcgggttcatcttaacaaatcaagacattagtgactagttgaagaagtatgtttattcatttggggaacaaacattcattgagcatcaactctgtgtcaggctctattttaggaactgtgagtgaaagaagttaatgagacatgttaacttggaagtccttaagatttcccagaagagagacagatatgtcttaaacgtagtctagtacaaggactagaaacctgctcaaattagcttcagagaaaaagagaaactattattaggttggtccaaaaataattgtgggttttgccactgaaagtaatagaatgatacacagatatttcatggatgtaaacccaggaagaacagtcagatctcacacaatggcaaacaaaattaaaagacctagaacaatctctctccgtgtctctctctttctctgtctgtctgtctcatgcatgcacacctcagtttcttggtctctcatatctgtctctgtttttgataaatggtgcagattggctttttctacactcattgaagaaaatgaatgggctgggcataattccaacactttgggaaggtggggcaggaggattgcttgaggccaagagttccagaccagccttggcaacacagtgagaccccatctctataaaaagaaaaattaaaaaattagacaggtgtggtggtgcatgcctgcccagctactcgggaggctgaggtagcaggatcacttgagcccaggagtttgaggctgaaacgaactatgaataccactgcactctagcctaggcagcacaaagccccatctcaaaaaaaaaaaaaaaaaaaaaaaggcgggggggaaaaaagaaagaaaatggttgtacaaagtgaacacaaatttccatttcatgtgatcagcaaagattctagaatctgtataccatgaatgtaaatccctaggagattgatcgagcttggtcaggtgtttggcttagcgacaaggaggcaggattatgtgactcagtgacttctagaaggggatcatggaagactctgagaaagccctattggcagagctggcaaatagctttgcatgtctgccacaagcatgaaaacaagtaaggccagtcaaccgtagttgtgctagaatcgaaatatgaatatgattcatcagtgtattgatgggtccaggaagctaggaaatctagaattattttatttgttttgtttgtgtttaagttaggagtgtctcttttattttggccattatgcaccccagccagtgcttagagacttgtgtgtgagtcaagctcaatggattctaagctttactcactcatcccatggattcactgagtaacatttgagaagccactggttacttcacttcaaaattactaggacttacctagaagttcatatttaccacccttttcaggtctagggagaagaatgtggaattgttaggaaactcatttcaatgtattataataactattaatatttattagaaatttatttactaggtataggactagactcttataacaaaaatgtataagatttcagagacccagcatttaaatgagaaggtagaatatacacatataactcaataatatattactctgtaatacatacaaaagaaagtttatttgggggaaaaaacaaaaacaaaaaaaaaaagctagaggaaaccagagccaagaaagaagaatgattagttctcagtgaagaaaatgggaaaggctgggctaataatatagaatttgactggagccttgaagtagaatttgaaacaatggaagaaaaaaagaaagctattctaagtagaaaaataaggaattgacaatgaagaatgggaaaggcaggccagtgaactcgtgaatttggcctaaacatagtgtgcaagagggaaagatagccacggagcccacagaggtgagttggagccaaatcgtgaccttaaaccctagggtactttgaatgtcctgaagacatctaatgattttcagcagatcagtcctgcatttttggataactgtgacaacaggtataaaagatgaactggaacaggagagaaggaagcacagagagattatatgggagtttgtcaccatggtgaaagatcaaaagggtttgaaccaaagagagattagcagtggaacagaaaataggagatggcacagaaaaccctagtagggtgtaaagacagaattggaatgggatgttagcagggggctggtggtgcacctggggaagaaagcagaggtttctggtttgggtgattgtctatatgaaaacgggataaacaaaggagggcagggcatgacgatacaacagatcagaaggaaacactggggaaacttatctgagccgtgttccccaacaaaactctgtcttgagctaaggaaaagaaaaagaggggaaggcctcacttcacccctgagtgctttttggagtagggtctctgggtctctcaagatcctttcaagtggccagtgaagtcaaaactattttcataacaatactgagacgttactgcgtttttcactgtgttgacatttgccctcatggtgcaagaacaaggatggggactggtggtcattgtattcttcatcactgggcactcacaggaagagaaagggagagggacacggagaggccagcagatcaatgaattttaatgccacggaataggaaaaaccattgatatggtttcagattccacattgcaactttaagaaactaccacttgttgagttttggtgtagtatcaggggattatccagaattatctcctgtttttctaagtccatatctgtgtaacaccagattaatcaatataatttcaccaaaactacatgccgtaacagattggatgcagaagcagatctgagaatccaaatgtctgtttttaagccagatatttaaaatattagcaaaaatgtaaagcaatgccactcttctcccggattctttcatttggagaaatatagttatttttcataaaatgtacattatttatgttcacacataataggatttttgttaaaggacttactgagtaaagggctcttgagaccaaagagtttgagaagccccagcttaaccttccatatttcctgctctgaatgtggtgtccctcacaactgcaactaggcaggagagcaccctggaaggggttctcaaactactttgtctcaggaacactttatcctcttaaaattaatgtgaggcaggagtttgttctttgtttctaaaagttttgcctggctctggaaaatcgtagctcctgacttattctgcacttcatgacagtgtaatgttaatttgtccagttctgagaacaaaaaccaagaaggatgcatgttatttccccccacccccagagataaaacacaaattcctgtctcacattaaaggaagtgtcctgcctcccaaacacaggtctgttccaaacacttactcacatttcagtgagtcagaaggaaacagacagatattcatctccctgaaacctggctgacttccttcaaaaagtctgtaaggagcgtcaaaatcgtgtcaccggttagtgagcagccacctaagagctctcaggtgatagccggagttttagtaagcaggtgagtaccccagacaattcagaaaaaaatgccttcaggtgtttgtcaaggtgagtaagtgcagccagtaagtgactgataagaaaacaggaaagagcctgggactatataatttgggttcaaagggtattagtcataagccatcagcagcaacatctgatgcataccaatttaatactttaacaatgtgacacatcagccctatctatagtaaagagaagagcttgatttttatgaattattaagtccttcccaccttgagccactttgcttcctagaggcagtatctcaggcatcccattcagctcatagtagcattccatgaagatctggaatgatgacaataatgatgattattagactcataactccttaagcttgatttatgaaaacagttcgttccttcacaaaagtagtcactggaagaattctggtttcagcaatgtgctggaaatttgtggccaaacttttggataaaacataagattcagacaagaaaaattaatatcctatttcttaggtttttaactaaaaatctcggatatagaatgttctctttccagatgtgagactgaaataatggaagaaaatggtcacagtctatgtcatggtgtaatgtagacagggagagtcacaagtgcatgtatgggctctcagccttttctctggccttgaagttaatctcctaaactcagtcattaaatcagctcttaattatctcggaggagaggaagtaatgatgatttctctctctctgtctctctgtcacacacacacacacacacacagctcttgcagcaggtattgcttaaatatcaccttggataatcataacttgtgagcagatcttctttcctgatgagttagtttctaacctggtcattctgcgcttatttttgtccctttctccacccacttaggaaaaacagagaaagggacgcaccgcgcagcccctaggcactgtggtttagggctagtgccctcggcacccgctgccaggagccgggcgctgccaagggctgcggaggggccacgttctcccggggactggggcatctcctgcgtgctggcgacaggctgcgggggcggagtggtgccagggcgggcgctcgcccgtcggatatgcccacccgtcccgtccagggcaggaaagcctgccagggcgccatccccatccccaccgcctccaggctgccggggctgggccgctgtacgggagccaaggtgcggtgccccgcgtgtggacgagccgaggtgcagcccgcggggccgcagggccggggtggggcggggcgcggccggagcagatccggtgtttgcggaatcaggaggggcgggctggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggtaagcggggatttcgctctgcatcggctgcaggagggacccgcgcggcttcctggggctcgctggagggattgggcggaactagggagcgagctccgtgtgttccctcggattccacgtggactcgggctcccagccaccaggacctgcttggaaagagatacttcttcgttcccttcctgctatcccaggccttgcgtccccattaggcgcgtctcgccctgtctgttaagcaccctccaaagtcatctcagtgagtgctttgttttaggtacacacacgcacacacacacacacacacacagacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctgatggcggcctgcagctccccagcgcggtgcttgctggctttgcagaagcctgcgagccccaaaatgcttatttttcaacccaaggatgtgaataatgcctctatttcttacttgaggacgaagcgctgtgtttcttcccggggggacttggaataaaccaagcgccacttaaatacttggcagaggggaattcttccttcccttctgccttcctcttattgttgtaacattgtctattcgacgaatgtaaacttaggctaggaaaagttcttttcacttctggatcctagatgccgcaatgagagaataagccggagcagccgctctaactgtagtgctgtggcagtggggcccgcccacctcctgagttcttttacactaagaggaggaaataaggctggggtggagagcttttgtgggaccatcgcctgagtactttttccctgaccattaggcagagctagagtgtggtcaaatttaagaattttagtttatttggagggagaaggagacacgtttgtataatgtagtttgaacagcgatcaaaacaaaacaaaaaagttgtctctgattttaaagtgtgtgtgtggttttttttttttttttttacaaagaagataaatatttcctaagctgtcctcctttgagactgacattcagccacttgctattctttattgtggaggaatgaatcctagtccacgtcaacctggtggcattttctccaggtcagagataagagagaaatagcaccactgtccccagcccgagcagagaatgggcatcttaggttttctgtctcacctgtattgggtgcttcagatactttctccgggaaccagatgagttgttttgaggggccaccaaccctaatctacggatttcaggtaaagttgtacttgacattgaaaatgagtctctggaatacaactagagctaatagaaatataaacccaagcttttcatctctctgtaattacccagtattaaaataagctgtggaaacataacatcattttcttatctttgaaatgttgaggcttgttatgtaaagagcagtgagaaattctttaatggaatgtaacgctgcaaggcatgaagtcaggaacagagacttaacctggagttaataaggacacctcagggcaagcaagcagagatgatcgaaaataacatctgcaaaagttttgtgcatttattccctcctcctactccagccatttgtatactcaaggaacaggttttctcttaatttaagatcctcataagaaagctctctcatttgtgatatcacttgaggttcctggagaagcagcatcgttttttggtaccatgagtatcccaggttaacatgaataagtgaaatctctagctcagtagtatctaaaattttgtatggcattaccctatctgtataaaatttctcattcactatcattacacacacacacacacataactgttataaaattatagtatgtacaattgcatcatatcacatacaaaaattcaaatttaaaagctatgtatgtgacagagcttcattatgatgatcttaaattaagagaaaacctgttccttgagtatacaatatgccgtgttatgtatatacaattgtatatacatatatatacctgttaatatgtataaaacacatgtgtgtttagacatcttgtatcatctctagcatacatgcaaaccactttaaaaacatatcaccttcaaatcttattttaacacttacattcaaatttgctttccagaaaccttttcacaggtgcttaagaagaaaatgtactcatagtttagtcctatatttatcacctttcagtgctcatttctaagtgcttaataccatgaaaatggtaaatgggcagtctgaggatgaaaaagagagaacataagaggcctagataatctataaactaaatataggccattagcagaaggcaaatgtaattttgaaatgaaggccatcacgtattttctccagtatgttcacaggtcaaggatagtccttccacccaggttctagaccacatcttttcttactatccctgaaaccctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcctcttcattctgcagattgtctctgggcccattccctgcacaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaaacatgaaagccaggaatttgtccccatgttttcaacctcacagccactctccaaattctcttggctctcctcccatccatgcaactcctgccacccagtcagtccctcatcttatgtctgtatgtaacttttaaactggattttcttttcttatctctccaacccattctcttcattttcactaatgatatctttctaagacacttatatgtttccaattactgctttgtttcaaatgttagtggctccccatctcaggtagggtaaagtgccaatttcttggcatgtcataaaaaggtacattctacctatccaatcttttctttactgtatgctttcctgaacacaaatacacattcacacacacacaccacacacatgcccacacatgtacacactctaaagccatctatatacaccattctttgttatgactacacctgatcataccatatttagtgtgaaaatattttccaaatactccctttgccttcattgcattgttgctttcaccccttttcactcatctctttgcaactgaccattatccaatgctagaagggtcaatcccaagcaaaattataaagtagagaacttttacttttgcaacaaaaaggaaagcttgaggtaacctacctttgctgggtcccaccctaaaccacctctctggtctcatcctcagccccttaatgggacttaggccgccctctgataaagtaactttgctcccctatggcttagcagttatacctgcccaacctcagctaagctttgctctcttaatactaggtcctgagccactgtttgacttaaatttatggactggggtttaggattcagtatttacaatggctcatatatttctgatgtatggtctggtttggaagtgattgcttaaatatcatcactgcctccccactttcctaagattaaaattccagtgttacctaccccttaccaccttgtgggatgatcaccaagacaggtagatttcaacatcaagagttagtggctgtgagcggctgtgtcagttaaattccttccgaagtggatgatgactactccctgtcttcatgtgctgacagccctggagatattaaaaggtagaagcttgttaatgtaaagagatgagcttctcatgatgtaattttagacattcagcaaaataaagacacatgttcagtcaatgtgtataaagtcaagaatttcaggaagaatggggaaaatatttggggccaaaagtgtccaggcatcacataaattctaccactaaagccataagtcttgactaccaacactgctcagcttgggatattagtaaaagatttagcacagcataaaacaagagaaaccatgaaagatcaccgctctgattggcaagtgaaagaaatggaaggttggtggagttctttttttccagttgttcagtgaccaatcatttaccagcagaacatacagaagagtggctccctacaggggagaatcctagcactgcaaatcatgagacaatagactctgtgtatgacagtgattcctatgccccttcaggtgatccatagaggctttattgatctggctacagtgaatttcataaaactaatacttgataatattcttataaggtatctactttatgtaaggctgtgtgttaggctcaaggtggaatcagagaaaacttaaaacatggctgagagaggttggagtttatttggaaaaaaatccaaacatggggaaaggaaattgtctcagccctgaagcatacttaaccaatttcagccccttgtcatcttcctttctagcagaagtccatttattgagttaccatcctcttctgcatagctaaaaaattgaggtgatgctgaagggtgattaggctggtcccaggcatctgggctgtgtctgatttagccatgggcatgtaatgcaaggttgaccaatgagatctgctgggtgacttatgggaaaagaattttcattcctaagagagatatttgttaaagaaaatattgtcaagtttatatgtgaaatttggaacaactacagccatcttgcaactgcgatgtcaactagcttaaggataaagctagtatattggagttagccttatggaaagaaatggactttgatgttgtctttgaacttctgaattattggaatttaagactatagtatgtcttggtgtctttaaaattttcatataatttaaaacttggttatatcattttctataacttagagagctgtaacatcagtttccatagcataatagatgtcatgtgttcacaattaatgagtggtacagataacatgttgaattcagaggatggagagatatcattgtgatacattgaagtgtctagcctcctgagatgtcttcatggaaacaggtaagaatcattacaatttagatctgccatgaagaacctcagagatcctggagtacagtttctaccttttaaaatggatgtaagtgatactagaaaagcaagcaacataactagcaataggactcgtctcctagttcctggggcagatgtttaggttcttgaatagaatactgacgcaatgaaaacagaaggtccttatgcccacaatgtggtattcaagttgttcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggttttagttttagtttaggagaccagttgtgagatgatggtggtaaaaactcagatagtggcagtagggaaagagactggaggatttattggaaaggcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagatttaggagtcattggcacctagagaataactgaagataggacattaacaagatgagtcaggcaaagggactagaagagggctttggccatggctcaaggaactgctttagagggtcaggtgaggaagaggaaatgtgaagggagagagtaggaacagctggagaagtagaaagacaactgcaagaactggggtagcacagaactatttggagaaggaagaggtagtgaatagggtcaacttcttcaaagaagtcaagcaagttgatagtcttgaagggcagtctacatggagtgaaaaaagagaaatcagaacagagcggccagaggagtaatggaagatgaggaaatgtagagagtgtgagaaagtttggtatgatagtaaaagggaggagagagtagcaagagaggtaaaatgggagcagctgcctttaagcaaacatgggaaaggcttgcataaaaattattataaggagattttttatttctgttacttatggtgctgcatggtacacttgtaatgttttaaaattgcattgaggtatatgtatgtggcagagattcattgcacaagagaaactgagggaaggggaggagctttgatgactatacaaaggatattatcagagagaaaggagaggaagagagttaggtgtccagcactagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggaaaaaggtacctcccatcctccagagtggctgcttagattgatgagcccatgtatacattttggtttcaaacatcttttcacactaatgcagttatgattaataagctgtttttagggcatgtaatatataacactccaattccagtggcataattaatatcagtgcgttagtcagatttcctaaaaaccaaacaagttcttttagaaatatagatttatgtttctccagttaagccttcaattccccttatttctatctagtttaataaagatccccaaaataatcttgttagaaataacagtctcatatatcacagagaaatagtgttgtctctgaaagattttgctagtaaaatgtgaaagctgtttgccctgtaacttagtgttgttttcaaagcatttcaaaacattttcattgaatcataaattagaaaagaagttgatgtctattcttaattttgttagtcataattaaagtgcttatattcaagtgttttatccagtctatgcctgctaactcttgaacacgtaatttacattttagaaccagtataaacttgaactgcatatttggctaatgttttcagctccatagactgttgggacagttaatgattttcaaatatattttacttcctttgagagacttgtctgttctgttgcccaaataggtaacagaaactttgcaattctgtcagcaaagattcctgcattattatcttgttctgaaaaggtgactgaaattcttccatttattaaagtgtctagagacagtttttgctacagaagccatatataactcctgaccactgaaaggctttctgtataaaaatgaagttaatttttaaacagagcaatggaaataaaagagtgttcaaaaaatggaaataaaacacagcaatggaaataaaagaatcactgtattgtcagtgcaagagattacttcattgtgttttgaaaggcgagcaaagctattgcaccgatggacgccttgaacattggcagttgtcattctcccggattcatttgaaggtggcctttgtttgtctttgtgcaggcctgatctcatttccatggataccatgtagaaatgcagactgaacacaagctggcttcgggtcagttcagtcagacaactctattccaaattgtttaccagttgccttcgagtcctttagccaacagcttcttagatgcttgttagaatagagaccccaaaccatcctggatttcataacctcttctaaaccatattctgaatgctggtgcataaaaatagatatttcaaaataattgacttagtgttctatggtggaagaggggaaggaaaaacttagccttggaaattggggcacttttatgtaatctttattattttttcagtataaaaatttaataaatagccctaatgagaaaatctaatgccacattgaaaaatgattaaaaatttatggaagtagtcatggtaattaagaaatgcctttattattacacagtatttaatttttgcccctcaaataatctgcctttaatatattagtgtcattttattattttttttgctatggttcaagtgagctatcaccttaactctttttaaaagtgaagtcccagaccgagtgcagtggctcatgcctgtaatcccagcactttgggaggctgaggtcaggagttcaagaccagcttggccaacatggtgaaaccctgtctctactaaaaatacaaaaaaattagccaggtgtggtggcaggttcctgtaatcccagctactcgagaggctgaggcaggagaattgcttgaacctgggaggcggaggttgcagtgagccaagattggtgccactgcacttcagcctaggtgacagagccagacgctgtctcaaaaaagaaacccaaaaaacaaacaaacaaaaaaggcagagtcccatgagctcctgccttttttcatgtcctctctctctttctggaatactctttagccccagcctccattctgtgcatcgtttaaatcttaatttcactgagattcatgcaccctaggaaccctgccaatcttctaattcaatttaggtatcactcctcacttggacccttccatagcaatgttacattctatttcaataaccctttcagaacttggctatagttcttactgactgcaagctgagaagacaggcccatatcatcttcacttgtatcaagggttcttggcaccattttattcaatgagtgatgaatctatgagccatgtatgacagctactgtaaggggattaaagacacactttctgaatgaaggccaagctgaaaaatttctacttctttccaattagtatatgcaaaaataattctatttgtaagtgtatctgaatttgctaaaatattcctttagttgataaatttgttttcacttctttgacagagtttgtttgcttttaaaatgtttttcctttttcataacatgtctaactaggatagctctgttgacaagtaacaagatgaatgaaagtattaggacagtacagatatcattttttccccaaacccttttctgttccccttttctgttctcataaagcaacaccataatttatcttcagcttgactctctctcccaccgaatacattctttaagattaccttctgtcctatttatcattgtatttcaggagcctggctcatagtaagcactcagaaaatgatgtattaaaaaagaaaaaaaatcaaaattcaaatacagtaaattttaaaacttttatttattgtaaaatgtaacatacatgtagacaaatgcataaaaggtaaatgtacagctttttagggcttgggtttcattttactctacttagaattagtaattttgtttgttactatttcacggatgctgccacaagacatgaaacttctgggtaagagacaaaggtctttattactcattgcacagcaagtaacttgatcagcatatctgtgttgataccctttgcccaccaagacacagaggggcaacacagagggcccagatagatgcctaaacatgcagtaagttgcattacagaaaaggaacactgagcatggtgaatctgctgttttgtagcaagtcagaaagcctgttctttgtcccacagggagatgttacctcattcttcaaagatgctcactgcaaagacatccctgagaaatgctatggtaaacagtcatcagggtcttgcatctcaggcatactcagcagatatgtaggtgtgttagatctccatggaagcatgtctcccaacacagcttaacacataattttttaaaatgttgtgtaagcacaactcagataaaaaaataaaaataaaagatttccaggatcccagaagtcccctatatgttcttttccaatcacaaatccatttctctagtcttatttttttggcaataatttccttgctttcatttatactcctactagttaaatataccatctacactcaagggtttaattttgctagattttaagtatacacacacacaattatacaatacatattattttgtttttgaattttttaacattgcaattgtgagattaatctatatgttgcacatagatatagttcttttgttttcaccactgtacagtaaatagtatagtatttttatcacacagttcttcatcaccagattgctaagagattttttaaagtgacaattgagtattaattttataaatatttttctgcatctattggttattacataaatttttcttctttattaatgtggaaaattacattgattgatattaaaatatgatgaaaacctggtatttgtggtataaacccaagttgatccacatgttctttttataggttgctggattttgtttagaatttttgtattcatgttcatgagtgtgattatcctataattctttatgtttcttactctctctactgtattgtccctccatatgtctgcctacacttcattctggttagtttcttttatcctatattactgtttactaatttttgtttcaacagtgtgtattctggagttaaaacattcattgagttcttaatgatggttattatatttcgcagtttatgagtttctatttggttcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgacaaaattgtttgaggcttgggtgatatttttctacataaagcattttcttttttttctttttctttttgtttttttttttttttttttttcttgatgaagtccagctctgttgtccaggctggagtgcagtgatgcaatcttggctcactgcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttacggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgattcaactccccagcactttggaaagccaaggcagaaggattgtttgaggccaggaatttgaacctagactggtcaatatagcgagactctgtttctacaaaagaaaaatttaaaaaattagccaggaatcgtgctgcatgcctgtagtcccagctacgccggaggatgaggcaagaggatcatttgagcctaagaggtcaaggctgtagcaaacctggatgacagaacaaggccctttctaaaaaaaaaaaaaaaaaaaaaaagtgatccaactgtctgcctgagtcatttctctgaacttctttcttcaccccatcttcttagcaatttgatgctttagaagacatcttaaatatcttgttttatatttcttgcaatttttcagtgatcttcagtgggagagttggttaaaataacaaagtcttttattgccaaaggagaaaatctggagtagtgttttagagtccccttttaaaaaaatattgatttttaattttccaaattctcctcatactatttattgatgtggcattttaactgatagaaaattagattttttcaaaatagattaaaacaatattcaatattggttagtattctaaaattttaattttatagtataaaacatttttgaccaataaattcaactcactttttaatatatatctgtatatttgcttgtattaattactcccttttctttaactgtgaagtaaatgtgtccattgaaatactaaacttgattaataattttatcttgtggattttctttataaagttgaatatttaaatatctttagagaaaaatgacacatactaaaataattaacagaaaaaatatttatatttcttttgatatttacatgtgattatatgaatataatcttttcatagatatactcactatatgcaaatgaatactgcacttttatcacttaatatattttgtatatacttttccatgtgagttttatatttataactttaatgcatcctgccatgccatggttaactattgtcccattgttggatatttaggttgtttcctgtgggatattttgccccccactgtaaataatgtggctataaacatcattgtacaagaagttttttcttttcgttttacttttggatcatttccaaaaggggcattactatgtcaaagagtgtgtgtgttttttagctcttgttgcatatggaacagtgtagccatctgtaatgtggaatttaccaatttcatcagcattagattttcatttacttcttgaagtttgatggatataaagtggtgctccatatttatttccattctttttattcatgagggtgcattttttcaagttacgatttaaaaatgcctatcttttgaaaaaaaatatttttagattagggtattctagaaatttgagctagaagaaacctcaagatatcatctagttcagtgtcctgctttattcttatgataaccagccttgaagtgactaaagaccatgactccaacctgaacagaacactccagccagtatagtgtccatcattttaagctacccattggggctccctctcaaaatctctttgacaaactgccctttgtcttttattccccacaggctgattacaatccattttcacttgaggcatggcaatcttctagttaaaatttccacacttccatgggtcagaaccctttaagggagagggaagacattctctctgccagagcacttgactgtgagtaactgaatctgtagactgttctggttaccccttgacatgtaaccagtcaccccaaaatttagtgatatgaaaccacaacctcacttattatctctcatggtgtcttgggtcagggctttgagaatggcttggctggaccatctcactcgaagtctctcacatactgttagagggaggcagctctccctcttcctgtggtatcctcaagcctctccacatggtgccctctgagtaagttgacttcttgcatggtgggtagggcaccaaaggcaaccatcccaaaagaaactggcagaatggatgggcttttataaccttggctcagaaatcacataactgcatctattcatcaaagcaatcacaaagtctcacctagattcagggggaggagacttaagattccacctatggatggggagtgtcaaaagatttccagacatatttttaaacaaagtagtaacttaataaacttaatggtcctcgaccattcattgttttctttttctttttcttttttagagacagagtctcacgacgtttgcccaggctggtcttgaactcctcagctcaagcgatctgccctcctcagcctcccgaagtgctgggattacaaacttttgagagaccatgcgaggccccatttgttgtttagaccagtgtttgggcatggatattattgacaattggggccagataattttttttgaagtagtaaggtaggctgggggtgtctggtctgtgcattgtaggatattgatcatcagccctgtcctccacccactagatgttaatagcaatacactactccagctgccctagagtgacaaccaaaaatatgcccagacattactaaatgtcctctgagggataaaattacatccagttgagcaccactgcactaaatgaacatatattaagcacatttaatgttcatggcaacataaaagagaactccaactctggagagtaagttaaatcccatcatttttctgagtaactttagataagccataggcaaacaattccctaccttgttgggtcattgggaagatcgaaggggattataagtgaaaaagtatttttcatattgtaaaagcatatggaatattatttaaaaaaaaatcagtacacttggtatgcatccatttttatcatcattcatttatttaagggaccttcttaagggacttttatggagtgcctattgtatacccacagagtgtcaggcctggggcactggaggattgaggcagccagcccccttccagaagctcttctttccatttctagcatcacctggacaggagaatagtagcacctagatccttagtgactgtaaagtttgacacttaaagcaaggactttctaagaaaattgcatctttctttttttaataaaagtaaggggaaatgttatgccactgcattccaaaagcagttgtaagggtccttttgtgcttttggtttttgctctaatgttttgtttaaggactagagccataaaccaaacattgcagaacttaaatctttacacagtgtgtggtcatttccaaaaggcctacaacttctaagtttagttgctttgtttttttttttttttttttttttttttttttttttttttggagggggaggagaggactttctacttgcattactgtcctttcaacatgaagacaatgctattggaaaatgagatttcctgtggtgatgtatgtgttcaaaagatctaatgtgacctatgatcatttcccgttgccatacacattctgagtaatgatgagatacactttagagtttgaagtctatttgcttaggttcagagtcagggtctgagtaaccccacttcctgtttgtgtgacttcctggagggtccatggaaggataatattttcttggcttttgtggtgtgcttctcgtgtgtgtcagcaaaatgcagcaacgtgtcatcctcctaaccattagacagcaattttcagaaatgtgaatataaatttgctcaggatatactttttatgttagagatgaaagtgggggccaggtgggcagatcactggaggtgaggagtttgagaccagcctggccaatgtggtgaaaccccatctgtactaaaaatacaaaaattagccaagcattgtagcaggtgcctgtaatcccagctaacaggaggctgaggtaggagaattgctggaacccgggaggtggaggttgcaatgagccaagattgcaccactgcactccagcctgggcaacagagcgagactctgtgtcaaaaaaaaaaaaaaaagatgaaagtgggataataaattgctatgccttattaaatttctcaagaagtgtgcccccctcagtagtgtataatgatactaatcgtaaaaacaaaaaaaatctactaagtacttaccatttgttagacactgggttgagagttttatatgcattgtctgaccacaatgaggtaaacatatacatgatatctattttacagatgggaaaggaatggcttatacaaaacaaggaacttgctcaaggtcacagtactattcaaacctcagaggccaagctcttaggcactgcgatatactactggctttgctcagtaaatggacctttcagcttaaaaaatgctgtacatcacaaactaacacagaaacagaaaaccaaacacagcatgttctcactcgtaagtggaagctgaacaatgacaagacatggaccccgggaggggaacaacacacactggggcctgtcggtgggggcgaggggagagagagcatcaggataagtagctaatgcatgctgggcttaatacctaggtgatggattgataggtgcagcaaaccaccatggcacacgtttacctatggaacacaaacctgcacattctgcacatgtatcccagaacttaaaataaaaagttacagttgtgaaattttttaaaaatggtgtacatctcttaatggtattagcatacttctgccatgccatcaccccgtaatatagtcagtcttctttttagggttctcctatagctagattcttgaaaaagttaaatgttctgtcaaattctaaatagaaaatacaatgtgtttatttgcatgaacatatgtgtatataggtatgtatattttaaattaatctgtcttttaattcattgatgtatatacctgcacagtagcctgcattcaagaggatttattagttaattaaactgttctttattaatctcctattatatccgtaacttattgttaggtggaaaggtgaagcaatcagtgtttattcagtaattattattgaaccacgaccatgtgcaaggtattattctaagtgctggggaatatatcagtgaacaaaatagacacagcccctctctgttagggtcaaaggcatatttattataaaacaagtgaagccgaagtttcaggggccctccctgtgcacttcccttcctctgttttcacagtgccagatattttcattcaacatgcaaaaggttaaggtcaccgtctcttttctatcctaacacaacatatttcaacaacaaaaacataaaaaaaaattcattaatcaacttcatcaattcagaggttctggattaatcactataaaacaaagcatgaggtgccttgaaatgctgtagctcctatgcagacttagaaaacagtcctaaacatgtgcatggcatcacaaacagggaggtgtgaaagtgaaaggagcttttcctaactacgaataatgataattttaaaaattcaatgtagcatgctagaagaaaaaatgaattctcttgttctctttagagaataggacttaataaaattgctgtcatgtgaagaggtgatatagagcagagccccaaactaggaaaaaacgagttgcataagtgtgtcaggcaatcagttggatttccaggaagtacactacagtaagagctgccaatagtgagcatcaaagaagttggaagaaaggtatgcacaggctaggatggtcagaaaagaccctaaccaaaatttatagagaagtggcttgtgaacagggtataataaaagaaatactaacttcagttatgtctgttttttccatatattgcctcaagatatgtgagacatatcctgctaatgagcaagttaggtgacaggcactgacttgctaaatacacacaaaatatgctattttgagagagagaaacggggagagagagagaaaaaaaaaagagaaagtttatcctttcacatagaagcaatttaggaagaagtggagaagtagaaagtgacttcatgagatggtatttctagtaactcttgggccaacacactttcttctgtatttcactgtcttcctctcagccactgagagacggcaagtctaccagatggtggcttaccctccagcaatcttatgaaaaagagagaatctattgagttgttaagaagcactaagtcataataaatggacattagaggcaattgcaatgggcttttggagatgttcctggcctgaagattgaatttttgaaatgtgaaagggcctccaaatgatctaaacacatgccacagtactccaggacttgatgcagttacaaaacaaaatgaaaacaactttggattgttttcacacaaaatataaaccttaaatgatacaactggaattattgtatatctgtccttatatttatatctgtgcataaatgtatggacagaattatcttcaaaacctgaaatagtaaattggaattttctggtgtaatatactttctccttgtattagtcagctcgggttatcataacaaaatatcacagactaggtggcttaaacaagagagacatattttctcacagttctggaggttaaaagttcaagatcaaggctctctcaggttggtgttggtttctactgaggactctcatcccggcttatagatgggcactttctcaccatgtcctcacatcacctttccctatgtgggtactgagagagaaagatctctggtgtctcttcttcttgtagggacatcagtcatactagattagggcttcactcttaggacctcatttgaccttaaccacttcattaaaggctctgtctccaaatacaatcacattgagggttagggtttgaatacaggaattttgagagacacaattcagtttgtaacaccccctttggcttaatggtttaaggggtttatttctggtcatggaagtgacgctcatgtatttctttgatatgaacacaaagtaagtgtcaaacatatgatatatggacacactgtaaaaaacaaatagccgcaaatcatgaagcaggatattatcgccagatgtcagctagagtctctctctctctgcctcttaaaattgagataagatttattcaaatccctattccattcttataagaaaatgcagtgccctctcaagatttccgtgaactcccaggagatgtgcattttcattgacttgggccctcacttcctgactgcagagtgtttattctccactctgccaggtctggtatttgattttgaccctaggtacagtcaatacattagcctgatactgtctcatggatgctacaagatgccatgacatgcatgagtcagagaaggactttattactcacagcacagcaggcagcacgagtatgagcatgtgtctatcagttcccctttccccactctagtctcatagtgttacatgaaggggcccagacagacacctgcacacagtggggtgcaagacaggaaagaaacaatgagcttggtggacctgctgctttatagcaagcagtcagcaagccttctctttgacctgggggaagagattatctcacccctcaatattattcatcataaacacaatgctaagaaatggcccaggtaaatagtagtcagggccttgcattcttgatatacccattgtattaagttgaatggtagtctcccccaaatatgtctctattctaatccccaacacctatgagtattaccttatctggaaagagggtttctgtagattgccttgaggagactgatggtaaaaacatgaaggctcaagctacttctggtgagggctcagaaggaaaccaggaatatgctgttggaaactgcagaaaatgtcctcattatacagcggcagaatatttgacctaattgggtcttattgttgttcagaaagcatacaacttttaagtgaggaacttggatatttagctgagcaaattttcaagcaaaatattcaaggtgtagcctgtttttacctgctagatatagtaaattgtgagaggaaagagataatttgaaggatcaccacttgatgatctggcaaattctcagcctatctagattgattatatattttatatatatatgctgagtgttatggactgaatgtttgtgtctctccaaaatgcatgtgttgaaatgcaatccccagtgtgatggcatttggagattgagtctttggaacataattaggtcatgtggatagagctgtcttcctgccttgtgaggatgcaacaagaagtcagcagcctgaaacttggaagaaggctctcaccagaacttgaccatgctgcacaatgattttagacttccatctccagaactgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgcattacctacataagaaacctgcaaatttttaaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccattatattttggaagcaaataacctattttctaggctcacaggcttagagatggagaggaattttgccccaggacagatcatgcctggcatctcactcacaccaaatttagatgatgagatttgggacttttgagctgacaatatttagatgagatttcgagctcagagttaattctgtaatgggttgagccatttggaaatgttgagataccttaaagaatgtattttgcatgtggcatgaatgtgaattttggggggccaggtgacagagtatagtggctcccaaaaagatatgtccatgtcttaatcactggaaccagtaattggaaaaggggtctttacagatgtggtggttaaggatcttgagatgaaaacatcctggattatctgggtgagagctaaatccaatgacaaatgtttttgtaagagtggggcagagggagatttgacacatgtaaaggggaggaggagatgtgaccacagacatagagattggagtgatgcagacacaagttaaggaatgctcacagccccaagaagatagaagaaacaagaaatggattcttctctggagcctgcagagggagcagagccctgccaacaccttgattttggacttctgaccttcagaactgtgagagaataaacttctgctgttttaaaccacaacgtttatggtaatttgttacagcagccagagaaaactaatgtatccattaagacatatagaggggccagagacccatagaggactgtctttcccagctgactaatcctgtagttgttcctttattttgcctaaaaggttgaattttcttccttaactttcccacaaaatcattcatacaatacctttgtgtgtgcaatgagcttttgccaaggtgtggtgagatcagaggcaagccaattacagcaatacaaacagactaaagtactgttaggcatccctgttgctgcaggtttccaacccaccgctatgttgctggtcatcctttctttccctcttgtcattgttcctgcctccctcaaagtcctattcagcttcctccttagtggccctgcctctttattactgatgccctgaaagttttatctgcacctcagtttatcaaggatttttctacacaaagatagtttctctctaaaatataagtataaaatattttccccattaaataataaatgattgcatcagagtaatagtgtttaaaaagaactttgagagattcattgtagtgatggtgaatatgtgagtgggggggagtgaggggagtggtaataaggaaggaaggtaggatgggaccaagaaaacccggactcagaaggatgttggaattagaaccagtcagagctagagaagcaaggtcctcaaggctgagaatatgttctcatgcatccagacatcaaagttacaaagtggaagaatttgccaacttaaaatgtaagtaatgagtgtatttgaaaacaaatttgtcatcactgattttagcaaaatctgtgtaaattaagtacaaagaaattgtcatggttataaaaaaaatccttgggagcagtaaagggttatttatatgtaaaatatcattatagtcttaggaagttgagcacagcctggctttcattctgcaccacagactagagtggagattccctcaggatgaggactgtattttaaatttcattgatgattaacactttctacagggtgggaaaatattctcctactgtacactcttgctgagaatttgtaaggtttgtggatgcatttggatttatttggataaaaaaggatgagtttgttcctaatacacatgagatagatttggttttctgttcctggcaccagatagcaacattatatccaaatggtggcttggattgactggaaagtttcaaataacattaaaaaaattaatttctatttttatttttggagaaggaagaaatgattctgtcttaagcatcagcatttattgctttctattatttttatttttaaacaataccattgttgggctacctttggtgggcatttaggttgactccatgtctttgctattgtgaatagcactgcaatgaacataggcatgcatgtgtctttatggtaaaacaatttatagtcctttgggtgtatacctaataatgggattgctgggtcaaatgataattgtgttttaagttctttgagaagtcaccaaactgctttccacaatggtagaactaatttacgttcccaccagcagtttataagtgatcccttttctctacaacctcaccagcatgttatttttttactttttattaatagccttgctgactggtatgagatgatatctcactgtggctttgacttgtatttctctaaagatcaatggtgtggagcattttttcatatacttgttggccacatgtatttcttcttttgaaagcattggttaatttcctttgcccactttttaatggggttgtttggttttttgctggtaaatttgcttaagttccataccgattctggacatttaatctttttcagatgcatagttttcgaatattctctcccactccataggttgtctgtttactctgttgatagtttattttgctgtacagaagctttttagtttaattaggtctcacttgtcaattttgttttgttataactgcttttggcatctttatcatgaaatccttgccagagccaatgttcggaatggtatttccttgattattttccaggttttatactttcaggttttgcatttaagtccttaaatctatcttgagttgatttttgtgtatggtgtaaggaaggggtccattatcaatcttctgcctgtgactagccagttatcccaacaccatttagtaaatgggcagtcctttccctatttctttctttttttttttttgtcaactttgtcgaagatcagatggttgtcagtgtaaaactttatttctggggctctctattctgtgccattcatctatgtgtccatttttgtaccagtaccatgttgttttcattactgtagccttgtagtatagtttgaagttggataatatgatgcctctaactttgttctctttgcttagattgtttttgctatttaggctctttttgattccatatgaattagaattagttttttctaattctgtgaagaatgtcattaatagtttgataggaatagcattgaatctataaattggattgggaagtatggccattttaacaatattgattcttcctagccacaagcatgaaatgtttttccatttgtttgtatcatctaggatttatttcagaagtgttttatcagtctctgtagagatctttcacttccctggttatctgtactcctaggtattttattctttttgtggcttttgtgaatgggattattttcttgttttggccctcagcttggacgttattggtgtataggaatgctactgatttttgtatgtcaatcttgtatcctgaaactttgttgaagttgcttatcaaatctaggagctttgagcagagactatggcattttctaggtatagaatcatatcatctgcaaacaaatagtttgacttcctctttttctatttggatgcctttatttctttctcttgtttgattgctttggctgtgactaccagtaatatgataaataggactggtgagggtcagcatcctcgtcttgttctggttctctaagggaatgcttcccacttttgcccattcagtatgatgttggctgtgggtttgtcatagatggttcttattactttgaggtatgtttcttcagtgcctaatttgttgagggtatttaacttgaaaggatgttgaattttatcgaaaggtttttctgcatctattcagatgatcatgtggtttttgtttttagttctgtttatgtgatgaatcacatttattgattggcatttgttgcaccaacttgcatccgagggataaaacctacttgatcatggtggattagctttttgatgtgctgctggatttggcttactggtactttattgaggaattttgcatctatgttcatcagggatgttggcctgaagttttcttttttattgtgtctctaccaggatttggtattagaataatgctggcttcatagaatgagttaggaaggagtccctcctcctcaattttttggaataattttagtaggaatggtaccagctcttctttatacatctggtaaaattcagctatgaattcgtctggtcctgggctttttctggttggtaagctttttattactcattcaatttcaaaatgcattattggtttatccagtttcagtttctttgtggttcaatattaagaggttgtatgtttccaggaatttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatgttgctttctgctagctttggagttggtttgttcttgttgttctagctcccattggtgtgatattaggttgttaatttgagatctttctaactttttcatgtgtatgtttagcactatcaactttcctcttaacattgcttttgctgtgtcccagagattctcatgttgtatctttgctttcattagtttcaaagaatttcttgacttctaccttaatttcgttgtttacccaaaagtcattcaggagcaggatgtttactttagatgcaattatttggttttgagcaatcttctcagtattgatttctatttttattgtgctgtggtccaagactgtggttggtatgatttttttttttaatttgctgagaattgttttatggctgattgtgtggtcagtgttagagtatgtaccttgtgcagatgagaagaatgtgtattctattgttttggtgtagaaagttcttagatgtctattaggtccatttgatcaagtgtcaatcaggtcctaaatatctttgttagttttctgcctcaatgatctgtctaatactgtcagtggggtgttgaagttgcccattattattgtgtggttatctaagtctttgtaggtctctaaggacttgttttatgaatctgggtgcccctattttgggtgcatacgtatttagggtagttaggtcttctgttgaattgaactctttacatgatataatgcccttctttgtcctttctgattgttgttggtttaaagtcaattttgtctgaaattagaatagcagcctctgcttttttcacttctctgtttgcttgatagatttttctccaactctttgcctttgagcctatgggtgtcatcacatgtgagaaggttctcttgaagacagcatacactcgggtcttgcttctttctccaacttgccactctgtgccttttaattagggcattcaggccatttatactcaaggttaacattgatttgtgcggatttgatcctatcatcaagttagctgattgttatacagacttgattgtgtagttgctttatagtgtcaatggtctatgtacttaagtgtgtttttgtggtagctgctaacagtctttcctttccatatctagcacccccttaaggacctcctgtaagggagaggtctggtggtaactaattcccttagcatttgcttatctgaaaagatcttatttctccttcacttatgaagcttaatttggctggaaatgaaattcttggttggaattgcttttgcttaagaattctgaatataggcctcaaatctcttctggcttgtagtatttctgcttataaggttcgttgttagcctgatggggttccctttataggtgacctagcccttctttctggctgcctttaacatttgttctctattttcgactttggagaatccgatgactatgtgttttggggatgatcatcttgtctggtatcctacaggggttctctgcatttcctgaatttaaatgttggcgtctgcaatgaggttggggaaattttcacggatgatatcctcaaatatgttttccaagttgctttctttctttccctttctttcagggataccaatgaatcataaatttggtctctttacataatcccatatttcttggaggttttgttcattcttttttattcttttttctttatttttgactgagttaatttggagaactggtctttgagctctgacattttttcatcagcttggtctattctgctgttaatacttgtgattgtattatgaaattcttgaagtgagtatttcagctgtatcagatgaatatttctttcttgaaatagtcattttgtctttcagctcctgtattattttgttgtattcctgagattccttggattgggttttgactttttctcctgaaccttgatgatcttcatttctattcatattgtgaattctagttctgtcatttcagccacttcagcctgggtaagaaccattgctggggaactagtgctgttgtttggaagtaaggagacattctggctttatgagttgtcagagttcatgggctgtttctttgtcatccgtgtgggctgatattccttcagtctttgaaattgctactttttggatgggttgttttttgcttttatcttctttgatgcacttggaggatgtgattgtggtgtttagtgaactggcattgtctctgtaagattatagggagcaaaggctcagccctgcactcctaggcttcatactctaactctgaggaactggcattgggcccccccgctttgttctctggtctttcaaggttaggcatctgctgcactggaggggccaaagtgttcatgctctatattgtccacaacactccgatgggggaatgccagccaaagctctttgttggggtggtggcagcaggatccatcgtcacttttatgtgacagcagctgtggcagcatggccgtgtgcccatgtgtcagctggggtggggctccagaaggagcagggtggcagcaacctgctggcggtgcatggtagcagtacagcaggggcagggcaccagtggggatgaggttgccagtattcctgtgtgcattcatgccagcatagcaggctgcccacacatcagctgggggtatggtaggatgagcatgcactggcaggggaggagagacaaggtcttctggcatgtgtgggccagcaaagcagtgttggggggatgtggaggggtgtgaggcatgggtaagcgcatgctggcaaaatgctggggagaggctgcggttggggaggctgtggctgggggaggctgcaggtaaaccattatgcatcggtaggggctgttctgctggagccctctgatggccaggcatggtctgtcagtgcaggagctctgatgaggtgccctaggaagcactctggttgggcatctgaagctgctctgcaagaggccatggtcaggctggagctccaggaaaggccagcagacaggagatgctcagataggactggccccatcccacgggcaagactgccctgctctgtccgggtccaacagtcaccctaaggctaaagtctcctataggagcacggcaggccttgagggatgggcgttcttggccatattctgctgttgttaaatcctctgggctccccactggctggagtctgcctttgccacctctctaagcagctgtctttgtgtcagctcaggtgtccgtgggggtcgtgagttccgctgctaggatgctggaggtccatggcaggagcaggccactcctcacctgttcaactgaccccagaagttgctggggaccaggaaggattcctggtgctgggcagcctcgtgtagggctcctagctttctcccccttcagcccagcatccgtgtcctccctcatccactctcaatgccttccctgcaaagacctgttcagagtgtgtgccagccttcccaatgtcctggtttctcggtcggagaggtttcttcgggctgcctctagtcagccatcttggctcccgtcttggtatagtttttgagtaacacaaagaggattatagaaagcatataaaatatttgtagaaattacatttattcttgaagaggtcatgtctaaaattagtgaaatactctttaaaacattttgttttttaggctgggcacggtggctcacgcctgtaaattccagcactttgggaggccgaggcacgtgggtctcctgaggtcaggaattcgagaccagcttgaccaatatgatgaaaccctatctctactaaaaatacaaaaattagcagggcgtggtggtacacgcctgtaatcccagctactcaggaggctgagatatgagaattgcttgaacccgggaggcggaggttgcagtgagcggagatcgtgccattgctctccagcctgggtaacagagcgagactccagtctcaaaataaataaataaataaataaataaacgtcaaataaataaataaaacattttgttttttaaatgaaaataaagggtactttaaaaaaataattttaaaataagttgaattatttaaaaatgattcaatgatttattgaaccacaaaggataaaagaagtaattcatataaataagcaaactcattaattttttatcttgagcaaaatatataaattagttacccacggtcacctgtgacctaaaaatattaaatggaaaatttcaaaagtaaataagtcataagtttaaaattgtgtatcgttccgagtagtgtgacaaaatctcactccatcctgcccaggatgtgaatcgtccctttgtccagcaggctgtctgaggcccctgcccattagtcatgtaggagccatcttggttatcagatcaacagtcatggtattgcagggcttgtgtctgagtcacccttatttatttatttagagatggaatcttgctctgtggtccaggctgcagtgcagtggcatgatctcggctcactccaacttccacctcctgggttcaagcaattctcctgcctcaccctgccatgtagctgggagtacaggcatgtgccaccatgcccagctattttttgtatttttagtagagatgtggtttccccatcttggccaggctggtcttgaactccttacctcaggtgatctgtccacctcggcctcccaaagtactgggattacaggcgtgagccaccatgcctggccaagtcatccttattttacttcataatggccccaaagtgcaagagtagtaatgctggcatattattataattgttctgttttattattagttgttgtttttaatctcttgttgtgtctaattttataagttagatgttattataggtatgtatatatagaaaaaacagtatataccatatagggtttggtattacctattgttttaggcatctactggagggatgggaggatcttagaacacattccctgaggataagagagaattaatgtaattctcattcctgcactaagaacaatgtttaccacatcataaatactcaataagtttattgagtgaacaaaaaataaataggaaaataaaatctgtttattaactgtgtgtataaattcattagttttgtattatggacagttttgaatagagagagaaaaaacatagaatcatggagaaaatatcacaagttatcatacagatatgaacaagtttatacaagacttattacaaacatagagttccatggaattgaagtgttattatgtgaccatttgagttactgagatgaaagacatttataaccattgcacttttaagtctataggcataaatgtagggatcccattcttaggacatgcctagcaaatgaaagtaagagtcaaatgcaacccaatgggccagagtttcctttatatattgtaaattatatatttgtgcatgtgacaataagattacacactgcaaatgatgttgaaataaaatagctcatgcttatagtccttctagtccagggtaggagaagcaattttctttcttcattattttatcctgattcttatttttattttattttattattattattattttttttttggtgaggtggagtttcactctgtcacccaggctggagtgcagtggctcgatcttggctcactgcaacctccgccttccgggctcaagtgattaacctgcctcagcctcccgagtagctgggactacaggtatgtgccaccatgtccggctaattttttttttttttttttgtatttttagtagagacggggtttcactatgttggccaggctggtctcaaacttctgacctcaggtgatccacccaccttggcctcccaaagtggtgggattataggcatgagccaccgtgccggcctttttatcttgattcttatacactaaaggaaaatttaaaagcagctacattacactcacaattgtactgtttgttgtgttactattcacatatattttacctttttcttctattctgaatattatttttgttattttattttcgttaagcactgtcatcttcttcacaattgctgtttttttaatggcaggataaaactctgtctagtttatatgctaccatttgcatattcacgcccctaatcttggacattcagataattttaatggtggttattaagaactaatttttttagattgctagaaattattaaagctatttaatatgtataaagtgtgttttcttaggccacctaagactgagagatgacataaaatacaaaatttttattagcaaaatagaatttctgtggcccagccacctacttacacacacagagagcctaagtgcctaaacactgttttctcattcttccggagtagataacattctcccagactctagagcatggttctcctggaaacctttgctgcccctaattgtgtcccctgtgtcctgatcactattgcaccacggcccctgccctcggcatgctctagttgctcactatcctctgccctcttccctgtcaatccttctgcagctactgaggaccagtccctcaggcatgggagaaatgtgctccaccttcttaaagtaatgacactctgtgctcacagttagagataggccttacagttcttatgtttttgttcaatatttaatggagacattgttccccctagaagtgcagtatgcatcttcaggaatgggccaaattgcaatctgagaggctgtgtcaaaaccacacctctattcccaagtccacctcttgcttttggcctttgctctcttctcttaacctgaatttcttcctatgtatgtccctgggcacgttttgcaaatgagtcccttctatgaaaaacccatccctgcccctggcccttcagtatatatagatatgctcaaatttgcattgaccacaaaagttagacccttttattttgccaccctttactacaaaatgcatcctttagttctgacactgatatcatagacatcaataaacttcccttgccaaatttttgtggttgaatataaaatgacatgttttgttttatacattatttacgctcttgttgttaaaagactttttcctttctgagtttcactgcatttttttttttgggggacagggtcttactttgttgcccaggctgaagtacagtggcacaatcacagttcactgcagccttgaactcctgggctcaaatgatcctcctgtcttagacggccattgagattacacgtgtgagctgccatgctcaggctttgctacatttttagaacaaaagtaggttaactatatcaaatccccaatcatatgtttctcttttgaattataacttaaaattatgctccagaagaaagtaggagaataaatttcatatttactaaaattaattcttaaattattgtttccaaaaaaattatttcagagatggtcaggaatcctcaggaaaggagatcctgtaaatttttgtttgtttgatttagagacagagtctctgtcacccagtctgcagtgcagtggtgccatcatggctcactgcagcctggacctcctgaactcaagcaatactctcatctcagcctcccaagtagctggaactacaggcatgcaccaccatgcccacctaattgtctattttttgtagagatgaggtctcattgtgctgccaaggacggtcttgcactcctggattcaagctatcctcctgcctcagactctaagaaaaataagaaatctacatgagttaacttatgcttgactatctggtttacttatggatattaaaatggcaaccagcctgttataatctaggatgaaacagtatcccctttttattgtgaaaatagaggaaactagttagccctgcatgagataaaatgtatttggtgtaagctttcgtgagatttactggaatactttggcctggttactgtcaacacgtgtctgacaaggtcacctttgttaaatatgttgagtttgcgatgctattattgcctttccaggcattcacatgaggacaaagaaggaagatttatactctgggtgataataggctcctggcaaagcccaagtcagttgaagactcactgcatctaatagagaactggaaatgtatagattaatgaagcaacctatgactctctgtgccagacttttcaccattgccgtactcttctctttcacaccctatgcctacgtttaacatgatgttcccggtgcctgggatgaactttgccttcctctttatgtagtgaattccaacttgtcctccaagatccagattaattgccatctcctctgtgaaacctttgaacttagatttaccctcttctcaatactgagctcaaggttctttttaccactctttattttaacacttatacattttgatgccattttttttagtaaaattaccataatggaaatgcaaagagaacagggagattttagttttatttatttgcagtatcctcaggaccttaaaaaacgcctggtacaaaggagctgtataaacatatgttgaatgatccattttttaagtatgtatagacacatgggcatggtttggaggaaggaaacaagatgaaccaaatatggttcttattatccatatgattcagttgaactatgaggacagacatcagaagatataggcactgggattgcaaagaagaaatacatgttgaattagacagaatacttccattaattttttatgagctatttagatatcatatgccaagtgtgaaatgatgacagagatctgaattgtaaatacatattaagagaaaaagtatagagaattgagattgtccagatttatcaaaagaggcaggatataaagggaaagatttaagtagctgaaaagagatttagtatcaatggaatgaagggatggtgataaagaaggtcatgctttgtgaggaaaaatgagcagatcatttatgaatagaaattctggacaataaagttgagagatgagccaaacctagactcagagtgggtgacattgcgcaagaaagacatttagccttcatgagtttcagtttccttatttgtaatttgttaataatagcttggttttgctgttccacaggattgttgtggcactcaaatgagtcaggatgattctgacataggcagacataagcattaagaaacagtaagatgcgagttggaataaacattataatttaaatagaggaaaaatactggaaggaaatacatctgaattaactgaacttacagtagaaagaaaagattatgaatgatttttcccttgagttttctctatattccaaatcattattgaagaacatatagtaattaaaatgcattttattaaaaaaaaatcctaggtgctgagaaagtaagagtgaataaaagaaacaaggtttgacttctcaaggagcttacattttagtaggcacagacaaaagaatatggctatataagataattttggataattgctctagtagtgatacagtgatgaagaagggtgctgctgctacacagagggccaagggagagcagagacctatttgagcaaagtcctacatgccgtattaggtgaggatgttataggcagtggaacaggcagctgcaaagcgcataagcagaatgagctgcatgtgttcaaaaaacagaaggaaagtgagtgtggctggaacacagggagggaggacgagagtggtcggaagtgaagtcagaaagatacaccagggctcaatcatgaaggacctttgaatttacagtgaggacattggattttattctcagttcaatggcaagacataagttaataatatatatctatgcatatatagtaacacatatatgcctatatatgtgaattgctgtataattgaactgctaaatgataaaatgaactccatcataatttcctgccattaaatgatctgcccaggtctaattaatgggggaaaatgaggttgttttatgtacagtcacgtgtcctttccagaattaggtattttaaaggtgaaagcagtttggcatcatctctccacgctaatatgttagatgattgataacatattcaaatagcatttattgagctctccacaatggggtgaagataaatgttggttgaaaacaccaggtattttgcatgccaattctggatctctgcttaatttgctgttattttcttttgcatttttttattattcaaaaataaaaaggagcaatggagcatatgaaaaatagatgttaaggagaaaatttgcagatgttaagctttgcagattttgctatagagtatttcagaatgagtatttgtgtttctcttcatggcagcacattatttgtaagaaataaaaagctgaattccttgtgtggacaaatccctgatacagtgattttggcacttacagagggacgttaactacttaaagtccccgttgcttcatcattgacttcattatcattttggagcactctacagaatctgctccctgaaatgcagaggcgcaatggaagagcaagcctttttcttccggcctttcagtgcctaaaacaatagacatatgaaataccatgcacttgcaatgctgcctagaaagtaggacatttctttgtgaaagcacatgttaatggaactttgatgtcaattttaaagagtccattctgtcttcagtgtctgcgaaggtaaatattgatcttaagcaacatgaggcatattcccatctccagagagagcattaatatccacacaaccttctttctgtaggatgaagaactggcagcattaatgctgtcagtgtcatacagagaaacatgatttgccttattcctttccttcattccctttccatcagaaataagaattttcaaaaaaaataaaataaaatctatcaaggctttatatgccttggtctttgttctgttttttgaaatgattagcatttctcaatcattcagaaagaagcatcaaaaacaaaacacttttgacagttcccactggaataaaaaagatatgacaccaatccctacattttcatcctcaaaaatgataatgatcacttctgaaagaaaatgataacaattttcaaggagctgtgattttctatctcctttgatgtagtcatcaatgccttttcgacagatgtttcatatagagtccatgtcaagatgttcaaggtgattcagaataaatagatgatacccttcagcccttgcccttgggtggcttagagtcttgttgttttgggaaggacaaatataactcaaattacttaagaatacttagagataatttagttgttttaagtcttgtgttcaaattttgtcttcatcctttcctctttccagctgtgagatatacttgtcccctggaacctcaaaattctctgcaaaacaaagataatattagtaactatcttctagcatttccatgaagattagtaagataatgaattatgcatatatagtatttagcttggtgccgggcctccaaataagtacttaaaaagcagtagttattttttctgggtaaacgttgataagtaataattattaggtcaagcaagttttcttaaaaatggcctttgagaattatacgacacacttatattcatgaattgtaaatatgtgctatttcatatttttcttaataggcattttaaattgttgtttggcctacaatgttggtctcccagaagcaaaaatattttccggtccttcaagtgaacagtttggctatgcagtgcagcagtttataaatccaaaaggcaactggtaagaatattctcttctttatgatttcagtaaaaatacaaaataaatttcatatttgacttcaattgctttttcaaattggtgcctgactgtactataaatgggtggccctcaaatatccttaaatgaacaatctttctttgagagttgacaactgcagactgatcattaatgggatggtataatggttcatttttaaaaacctggatagaaagttttctctaaatattcaaaagcaaatttataataccagttttgaccattaatacataggtaggtagattgatagaatgatagatttgtcttcatttctgatcatgtaaactgatattcattgaactttgtaaatcattacctagttattaatgctatctctggaccatttctaaatggtagaattgtttcctacatttttttctttagcaaggttttgtctacttgcttcattctaagttaggcttttgccctccttgtggtgaagggtcctcacaaatatcaatgcaaaatgtacaaaggtggctttctctagcatattaacaccttttgtttttgccccaaagtgctcccagtttttacatgctatgtgatggttacattttcaaaccatggcttttctacccaggtgaaaaacaaccacctcaatggagatggaaatctagttcccataatactaatgcaagtgaacccagagaaatgaggtaatttgaaagttgtatttgggaagaagcgctgtagctcctattctgccagagttcatgcccactggtggacacaggtcctgccatggggaccttatctccttgttgcagcaggaggctccaaccatccccactcaccctggaacttcagattctgaatctccactctctagagctcttttcagtgattaaatgggctgttgttggcttatcaaataagaaccgtaatgtatggccaagtgcagtggctcacgcttgtaatcccagcactttgggaggctgaggtgggaggatcacttgagcctaagagttagagaccacctgggcaacacagtgagacctcatctctattaaaaacctgaaaatcagctggatatggaggtgcatgcctgcagtcccagctactcaggaagccgagctgggaggttggcttgagcccaggagtttgaggctgcagtgacctatgttggcaccgctgcactccagcctgagtgactgagtaagatcctgtctcaaaaaaaaaagaggaaaaaaccgtaactgtaattcataagcctttttttctgtgtgaacttccatttgatactctaaacaattgaattcaaagaaaggttcaggatcacatgttggggcatgcctgtctatttgatgaggaaacaaaatgaaatcatcccctgagagggcagcatttctcagcaggcatcttggaggatgtaaatcgtgagctgggttttaagtagtgaggatgaagaggctggagatgagtgttaactaatgtgaggagacttagaaaacaatgcatgtagatacagtttgtcaattgtctagaaggataagaacatctggttggaaaccaaagattggcaattattgtaaccatttgggatacgagagagagttgcatgtctaacaattatcaaatgatgctttgataatcataaagtggtgaggaggctagaaagacaatatggtcggtatattttgaccttggaatctagcagatgaagtagctaatgacccacagttttaaatattcagccctaattttttccctcagactgctatattaaacaattcattcaacatctccactttaatgcccagtagacataccaaactgaactgggagaacacaagtatctgattttctgcacaagctaatgaggccaaaaatctttgacttgtcttctttctcctcccctatatcttatccatgagccagtcctgttaatcctatcaccaaaataccaattatacctggccgttcctcactgtctctcctgatgccaccctgatggaagccaacaccagctcttacaggcactgctgcagcagcttctccacctgccttcagcttcccttcctgccagctttattctgctgtctttgctctagccagtgtgaactgttaaaaacatggctcggccaggaacggtggctcatacctgtaattccagcactttgggaggccaaggcgggtggatcacttgaggccaggatttcaagaccagcctggtcaacatggcgaaaccccatctctactaaaaacacaaaaatcagccaggtgtggtggcgggcgcctgtaatcccagctactccagagtctgaggcaggagaatcgcttgaacctgggaggcagaggttgcagtgagccaagatcaagccactgcactctagcttgggtgacagagtgagactccatctcaaaaaacaaacaaaaaacacagctcattccctagattaaaattccttaaaggatgctctgcgattgggtgtcagcctctctcctattatcatcttttacaccttctcctctgctttctatgctccaagaactaagtcttttgtctgttccttgaacatgcctagctcattcctgttgcaaagcttttgcaaattattttctcctgcctggaagagtcttccctaagatcatcactcaaatggttttcatctttcagtctcagctcaaatgtttcttcctcatagacctttcagagcaaccctatctatatagcactcgactgctctctgagtcactccagccttacaggtggatttattttctaatgattagtactatcttaaatgatctatacttgtttatatgctcattatctgtctcctgccactgtctctgagttcagggacactgttttgttgactgctgcattctccacacccagagtgatatctggcactgagtaaaggatcaacaattatttgttaaatgactaaatggaagtcccaattctaaatgattcatcccaagtgctatacaaagtgagctatagtagactgacttaagatgtttgagctgaaagggagcttcagatgaactccactgttctagttcatagacatggcctagctgaggacatctggcaccgagtttgaagcaattcttttaagtaacagctttcctggacagagtaaatctaagagccaccatcagtaatagacattattgaaggtgataagcctttcaaggattgtaaggggctcaaccactggccatgctgctggttggaagttgaacaagacgaaaagggacacagagttgagaggatcccaccaggcagagttctgggaacatgagaggcagccatatctcctttctctgtccaggattacctctaagtatccaagacattgttgaaagacaagtatatttgtagtttatagtgagatcctagtgctggtaagaccagggacactggacatttctaaatcctgcctggaccttctcatgacatccctgaatgatgtataaacacaggacaataggtctgggaagcaaggcaccactctattattggctgggccagggctttgaactccagtatagagctttctggcaaggtgtagcactgagattaggctcaaggcctaaccaccagatgatacaagcataccccaccatgcaagaggaagagacagcacctgtctgacctgaagggctgaaccatatggaattcagaagcaggaaggacagagaacaaaagttggccaagcaagtctgtctgggtccttttgttgatctggtcttatgaagcaaagaaacaagagaggcaaaaccatgggcatgattttctaaactacatgaggtgcaaaaaatgcaaaacatagttgttggccttaaggagtgtaaaatagagtcagtgaggaagatttatatgcagaataggcaactttgaataatatagaagacatcagtcagtgtaaaccccttgcagttaatggtgtttgttttctttcagtgtcactagctataataacttaagagctcattttcttttcccaaggcctgggtcattagagagacaaggttttctcatgacctctgtcatttgcccagccctgccaaggtaccttgccacagagggcagggctgtggccaggatccaggtgaatgggttatcccattacagtgctagagtgggccatgttaggacaagcagtcttcacgactctcaggctcaaggaaaattatatgaaacttggaacccagaattgcctgtttgttttgacagtgggccctgtgcccttctctactcttaatttatgacagttgcataggcattatggaagtagcagatgtgggaaggactgtttaaacattgactttccttctgatactaatcaagttagttttggacacagaaattggtatgaccatgaattattcctttagcaaattgcgagttctttttccatggatttatcatgtaatacatgcacacacacacaactttgttttctttattcccttactgcttattctgaagctgtcattttggtatctttttcctctgcttactttgactttctttgtaatctttctatctaagtcctgacttcactcctttccctcagacaactcactgaaggctctagtctgagtattcttaaatcacactctgttatttttaaagtacaattttagctctgtcatgtgtgccatgttttctaagaatttatgggcatatttacatcaggatctaccagattttaacaaaataatcttaactcttttgctagtttcatttatgagactttcattgcactatgaacttcaactctagaaacagtggtgacatggctttgataattctggagcctttttaacagtctcaagtgagcgggataattttaaaacaagctgacctcccaagtagagtacctgggcagccctctggctgtaagtaaggctgtggtctgttctcttttcggtgtaggcggagggccatcccgcttcagagccctcacttcacacacaggatgttccaatgtggatgatgcaattcttatcacaaacaatctacaaaggattgagatatgtttaaaatcatttcctggagtttgtggtgatatgcactctttctgtttgtctaatctgaaggcctgttgcaagaacaatctgagctcattatgtgactcaaaaaccagagagaactgcaatctctctgtgtgatgaggactgactgggaattagggtatttccagttgtagaaatgtctttcattctaacaaggactagtgcattctttttccttaaagagagaggagaaatagaaagaacaagtgtcatagcaaaaaataaaaataaaaaaaatccacctatatatgagcttatagttttaactttttaattgagaaaaactttaataaagctctacatgtgttatgaatatagcattgtcatccacagatgtgcctataggagaactttaaataaaaaaaaaagtttaattctataacagacatcaaagattatgtcacgtgatactttgataataacaccacctggtatttattgagtactctttccttgccaaacatgtaatacccataattactctaggagctttgcaaaattattaccccctttacaaatgagaggagtgtgactcagaaatgttaagtaattaacctaagattacagagctgataattaataaagataggggaagctaatgcaaaatgagacaaaatgttccaaacgtacatatttttgtaagtatccaagaaggagagtgacaggatgtagttggcatttataaataatatttaaattttattttaacataaactttatgaagtaagagaaactttcagaatcttgaatgaaaaattctgttagagaatttccaatgttagcatcattggctttaccatcagctgtttcctgggcaaagatgatagttaccatccatcttttcatcctatcatagacaggaatttcttgtatgaatatactcaggagccggagcacaagggttttaccctcagcttccccaccactccctgggtgactttgggaaagtcacacaacttctctggagcagaaagtatgccatccttatcaaactggaatgttatgagcaccttgtgtgagaataaaagtaaagcacttcagggctgggctcggtggctcatgcctgtaattccagcactttgggaggccaaggcgggcggatcacttgaggtcaggagttcgagaccagtctggctaacatggtgaaaccccatctctaccaaaaccataaaaaattagcagggcgtggtggcaggcacctgtaatcccagctccttgggaggctgaggcaggagaatcacttgaacctgggaggcagatgttgcagtgagctgagatcataccactgcagtctagccttggcaacagagggagattccatctcaaaaaaaaaactgggtcctccctacctcttcctatcccctcaaccaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttaccattaggttgtcctggcagtgccatttaacatgccaacttcatttattcacagagtttgcttatatcttatttaattaaattaattaattaattaattaatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggatggagtgcagtagggcaatctcggctcactgcaagctccgcctcctgggttcatgccattctcctccctcagcctcccaagtagctgaaactacaagcgcccaccaccatgcctggctaattttttatatttttagtagacacgaggtttcaccgtgttggccaggctgatctcgaactcctggcctcaagtgatcccatctcagcctcccaaagtgctgggattacaggcgtgagccaccgagcctggccctccttttattttaaattcataacataaatattccttttcttcttccattcaattttattttttactcataacttagtccagtgtttgattctataaagacattagaaatccaactgtaatatattcttacacttttattttaactttaaatacttactgttaaaaattttataaatacttattatgctattgctgtacaattaagccatcctcagcactattaatacaggtatccaaagtggcatgtctcatctcaacaatgacaaccccccaagaggcggaggttgcagtgagccaagatcacgtcactgcactccagccggggcaacagtgagactccaactcaaaaaaaaaaaaaatctatagtaggaaggacactttaaatatctcctgatttgcttcttcgttccttcactctggatacaagtttgtgtgtgcacctacaaacacatgaatacatacacacccattgtttgtgacttgcacgtgggagagatatgttgctccagaatgtctgctgtgctttaatgatctataaaaatcctccatgcctcaccaacaagtcttataattttaagctttcctctgtggtaatgtgtgaatatctgtttctggaataaagttcatttacaaaggtgactgggacttacacacacaccttcctagtatctagttgtctaagacatttacatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaaaattatccccctctctccctccaatagccaagaacaggaatttgtatcatcacaaggctttagggttagtattttagcttttgattttaaattcaagaaaactgcatgtcggatgagaggaagtaacataattagtttttattgattatatttcttctagtgccaaagccaatttctggaatttttatgagacagaacagtaagcttaagatgttttagcaatagtgaagtcagtggactctttatcgtgaaacggaaagatgctgaggatctagccatcccgctaactgaggagacaatgtggaagcctaagaagtctgaggcagcataatgaggcctaaatactaaaattgcctttcaatatatgccaaagaatttaactattaaatttatgatagcagtatttccaaataaaacctaaaaaatgaaatgactctttttacctgtcttccttcttcccagagacgggcagccttcacgggtgaattctttccatcacaaattcattttatgtttaccagcagaaagcaggtaccatttagagctcaccaagcaccttgtgttgtccgtggcctggaactaaacaatataagaaacaatatttatatttatatactatagacttggaaaatttttacgtgcatgtagatacaataagtttctaatccaaagtaaaatatccccttggatggctcatagacctctcaaacttaaaatatctcacagtgaactcttgagctccccctatcgcaaaatcttgctctactgacagcatcccctttaatctgatggtagtgactagtttcttttagcttctcagccaaacacctttaggctgtctttgactcgtattcattcattcattcattcattcattcattcattgaaagaccaactcctcaagaagtcctgctgcccctaccatcacactctatctaaaacaagaccacctcttaccactttcccttctgccagccctgtatgagcactccatcatctgttgcctggatgattgcagttgtcttctaagtactttacatgactcacctgtgcttcaatacaatgattcccaacagtgtggccttcaaaattcttctacaatatgtcagatcacatcatgctgtactcaaaaccctccaatggcattctcatttccctcagctggaaagctgaggccttctattaatcattacgtacaagtcactacatgatctatcattaccagtaggactaccatctccttccactatccccctcactcattctgttccagccacagggcttttgcatttgctgttcccgcagcctagactattctgccactagagtcttaaggtttactctttaaccttcttcaagtttttacttaaatattaccttctcagtgaggccttccctgaccattccgatgaagattatactgctctccaccccacactcctaactccagcctgcttatttttctcccaaagcactgatcactaccactatatggtttacttacttattacatttactgtctattttctcccactagaatgtaagctcctcaggctagaaacttttttactgatttattcactagtatatcctcagtacctagaatgaggtctggtacataataggtctggccaccacgtatagactcacagattgtatactgcacaaggcctggacacaccattcaaggaatggtgtcccctggggttgtgtaccatttcagtccccaagagcccaataaacatttgttataaaattgaataaaacaaaatgttttgccctactattttaagtacatctctgtcagtaatctctggtaaaatctctagtattgaagaaaacacttggagaatttacagactcacagaccaaaggaagatatttataacagcccctagattgtgggtttaaaactgtcctacctacaccaccataaatactgcttgctaactaaacaaagtattttgaattccactggaggtaggcaaattggctgtgttttgaaagtctacataatcactattttcccacaagataattgaacagtaagtgttatttaaagtagtcttggaagaattcccagtttcactggaggaaaagaaaagtttatatcttgggattttgttttgttttgagaatcagcacacatgcctgttcatgcaactcttttgtctggttgggattaaattaaatccattacttcaaagaggtttcgccatacttcaacaggtatactcaccaacatatccaatttcccaccttggtaacagtttctcttggtgtgtctcttcctgcacgtaaaatttcatagagaaatataacagcctccctcatcttcctgtctgattaatttaagaatgccacaattttcttggaatagcctcttggtgatgtcctagcctcttcttatgagggtgagttgtcaggaactaggatttcaccgaggccttagggtgtgaatgaggaggagagtctgctggaaatgtttctaataaagaaggtaagcaaaggtcagtgacttctctgtagtcaccaacatgacctgtagcctacttattaatgtggttcacaatatttaagaaatgagtcatatatgatgaggaaacccttgttcttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgataaaaaaaaaaaaaaacagttaaattttagatcagacacacttctctgttgtttctcagcaagcctctctcgggctgtggtgaggatggttggaaatgtgcataatagaatcacctgaatttggtatttgcatttggtattgtctgaacataccctgttcctacctgtcattgggtttgtatttggtgttgtctgaacatgccttgttcctacctgccattgagaacagtgtagcctaggccccacagtatggatgtaccctcccaggacagctgtgcttcgtgtccagtctgcagccccttcatatatcacacagccacacaccccttcacataagtgtggcctgactccctgtgtctggtttctaatccatgctagttctagaacccacctcatctgctaagatcattttcccaatctgggccctctgccaggacttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacgttaggaggttgagaccagcctggcaaacatggcaaaatcccctactaaaaatacaaaaattagccaggtgtggtggcgcgggcctgtagtcttagctacttgggaggctgaggcaggagagtcgcttaaacccgggaggtggaggttgcagtgaaccaagatggtgccactgcactctagcctaggcaacagagtgagactccatctcaaaaaaaaaaaaaaaaaaaaaaaaagtaaggattttctgcttaacttttccttaatcaggaaactcttttttaaatgatagcatagaatcatccattcatttgcttgttcatttgctgttgttttttttaactcatttgttcaacaagtggttattcattgctacaggcacagaattcctagccctcatgtacctttcctctctagtgagggatttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccagggttagagaagaaagagtcagattctttcctttttacactttaagatatgtccagcatgcaaaaatcagagttaatgctgtgtaatactactatgaaatgaagacctgtacagatggagaaaatcaaggctctggaagacaattttcttggtaccgactctataagattcctaatttcttctgagctatcatgaatttgaaagacatcagatatgctcaaacacgcgttccaattctgcactggttccctcccttcattaaagtggctattgggacttactaacatccaacattcagatttctatctttttcaaaagccttaacctatctgcctggtattattgtaaacctaactatggtaatattttaaaaggtaaattatggtaaattattagctcataagaagaaaaaatctttcaactctaacgttaaggctgactgaattaaagtgtgctagagtgttctatcttagtttgagaataattttataagatgaacgaggagagaacttattaatgaactattaactttcaaaataatctgcattttcctttttccctaagtgttcatgctattctgtctgctaatacttcaggttaaaaccttcatcctttggtgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaataattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgctttttatgttcttaatgtagctggctactagaaaatttgaaattatatatgtggctaatattcgtagcttgcattatatttctattggacagcattgctttagagagactttctagggtgtgtggcaatgcagcagtgttacagacattgatcaaagctctttatcagctaagcagaaaggcagcaggtcaaatcatagctgaacaaatataaactgttcacattgaaatttaaatgtgtttttcactgtttgtgatcaggtttatctttaagaaactatacttaacactttgtgtctaataaaaaaaatgtgtttctaggttactggttggttcaccctggagtggctttcctgagaaccgaatgggagatgtgtataaatgtcctgttgacctatccactgccacatgtgaaaaactaaatttgcaaagtaagtttaaatttacttgcaaggcatgtgatttgtcttagactcaactgaaaaataacatcagaacaatcattgttctgtcttaaagaaatacagacagcttttttttgcccttatgtctttagtaatatggggcacaatcatatccaaatttccaaaacagtttggagacttgtcttaacaagatgcgtggaaaatgtgctatctcctggaccatttacctatagaccatggactggtttccatcaacatttagaataattttgatgattacttgcagaatcaaggctatccttgaatccgaggctatccatatttctttctctcctctttgcaaaataaaccattaagtttggaaacatcagtacaagggctgagtttggaggcaccaaaaacactctgtgtttcttgttatgtctaaatgatggcattctaataaaacaaatccacaatttggaattatttgctgttttaattatccccatctcagatgcctcctattaatgccaaaaatttactaaaggttcaagggtagacagctaaatgagtgacatttccatgtaatatgctgatacaagtaaaaagtcactcaatttgatcatcattacatcatcagcagcagcagcctaaaaaaacagccctgaggaatcacggagttcctctgaagaattgaggcatgaattagaaaagagtgttgtgaaaatcaagggaaagaagagtttcaaaaatagtgattaagacttggaaacaagggaagtggtgtttcttgcatatctctgtagacctaatatctagaataatttatggcacataatagggctcaataaacatattttcagtgaagtagaaggaatatcagtagtgtcaaatgctacagaagttgaaggggatgaggactgagtaaatgtcttcagcttatttaagcaggttgtgggtgatctagatcagtgatctccaaattttttgaacactcagtatatatatatatatatttctaataacacaaatatatacatttggagtgagtgttcaaagctttattatatagtccaaaaattttagtatatcacccctaacatttcatatcacccttaacttctgaacactcattcttaatgtatatatttttattatttttaaagctatatacatgtactggcctatcttctcaataataccttcacataaaaataaattttaaagaataacaacatgcccatagaagttctattattttctgtcttcactctaacagatcatattttgtgtaacttactcacctagaggataaatccaccagtgttatggggagaaaatagataacaaagaatttaggagtgtgtcagtagtgaatgtacaaggagtgaaagttgacctccatttccagaagttcagcagtgaagggggagctgggaaaaacaattctatgggatagcagtgtgagaagatttttctagtaaacaagagatgatactttttgtagggaacatggaggcagcagtaaaaagggatgatttgtccaggatagagttaactgattaaaattaatgtcatttgtacctgagaaatagagtcttaaaaagagttcttccttctctaagacacaaaggaaggagagaaaaattaggagttctaagaatgatctttacacaatgattagagaaactgagattaccctggaagtctgattcatcttctctgcagtagtcgttattcactgagtgatgggatctgagttgaggttggaggcttgaaaagaaggggtgaacttggctgggcatggtgtctcacgcctgtaatcctagcactttgggaggccgaggtgggtagatagcctgagctcaggagttcaagaccaacctgggcaacatggtgaaaccccatctctactaaaatacaaaaaattatccaggtgtggtggtgtgcacctgtattcccagctacttgggaggctgaggcaggagaattgctagaacccgggaggcagaggttgcagtgagccaagatcgctccactgcactccagcctggatgacagagtgagactctgtctcaaaaaaaaaaaaaaaaaaaaaaaaaaaaaaaagaaaggtgaacttttacaacagtcaccctgggaaataagggaaggaatccaattaagaataagtgacagaggcaatgatagcttggcagagatgagaaacatgactgaatgatggtattactaaagagaattgcaatgttcgataactcaagaatggatacagtggttgatgccctaggtcagtggaagacaggaggtggagagatttatttagtatattatatgactcgtctaatttccttttaacattcacccactattgctttgagccagattctatcatagggcattctttgataacacttcaaggatatttttactgacccagaaaaaaaaaaaggcattagatagagctactgtgactttcaaaagagaggcaaaaatgatgtcctcaaatgtgttttgttttgctagaatattgtaaaaaaaatcataattaaacatctataagtcataccctctccagagcccactccttactgtcttatgctctgcagcctcacacattaatgtgcgttaccagatcactgaaagcatcgcgtttccccacacttcattatataactcaagtacctatattgatgacactaaattcaatgctacatgcaaacatgggtgtgcctgttttcttttaatatctttaagtaaacgaggaatttttaatcacttttaaaaattgttttccctttgaaagcttcaacaagcattccaaatgttactgagatgaaaaccaacatgagcctcggcttgatcctcaccaggaacatgggaactggaggttttctcgtgagtgtttactttacaaatcattattcctctcaagaaagtacatagacagtagtgtcttctcaccatccctcccaatctgaggatttagatgtttagaacttgctttttgataaattatgctatttatttggctatccaatgttgaatattcaaaataatgttgatgtgtagactttttaggatattcagcaaaaccactgctactgaatgttttgaagaaaagggaacaaaaagaaccctgattctttgcccttggaaagtgtgctgagtatttgttgataacagcagaatcccaaatctcatttctacttcctgtaggatcattcaagatagtttcaaagctaaaaagtatttttggtttttaatcatttcctgtaattgttgagtaatctggtgttatctgaggcatggagcagtctctcatgtcagtgctcactttcatttagttacaaaaagagtaaaaagacatcactaatcagtgaaatagaatgccttatttaacaagtgcttttggaacaattaattgattaatatttacatatccaaatacactgtcaagtgaattgaaagttaatataaaaaaactagaaaaaaatggaaattttctgaaggatggaaaaatttctgagtttagagctaatagaaaaaataatataggaaattgttgaaaggatttgactatataaaaaaagggaaaaacatcacacaccaaaaaaaaagtttgaagacaaaaacacaatcttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatgtgcctcaaaatttttaatctataactccagataaagtaaaaaatgaaaggtaaaaagcaagagaatttgagagattaattagcagtccaggtagcaagcagagaggcagaaagagagagaggaggagaaagaaaaaaagaaaaaacccaaagtttcctttacatacttagaaggtcaaaatcataagatactcttaagaattatgtggaaaagactgacaatcatcacatttttttgaaacttcttaagttctgggcttaaagtaggaatgtagttctggcacttacaattggcatattttaatttcaacttcttaatgctgttttccattgcttttaaaacaaaaaaaaattttgaatacttcatgagttctttttcaaagtgattttaaaaaaagcttaggaatggggatatagaaaccaataattagtatctgttatttggtaaactaaccaaagacattaataatgactttcttctaattaattggcaaaataaatcagttttatagggagaaaactatgccttgttcattgcacatgaaatatggccaaagctgcttcccctttgacagttaaactgggtcaaataagttttcttttatttttccaattacttcttgcaagcccatactcttctgttcagttttataactgattcacaactttacataacgttaaattctgtaggcattttttaggatcttaattagatttctcttttgcacttgtctcctttttcatgtatcaattttaaagttatttaatctaatgtttcttgtgtcatttaatcatgatttaatcaggagtttttggcattcaaggactcctgaaaaggagagaattgggattgcattaatggagatattaaggattggagcaggtataatgtgagcaagaagacaagtgccattcagcgttagtgactgcagttaattgggaagtggccaaagttaaaaactggtagtcagtgaacctcatttgtgtttgcttagcatatggagtaattttgaactgaattttcacacaacatttgccctctcgactctcttttacaaattagggaatctggcaacacaacctatttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaactaatgttcagcaagaacaatgataatgatgctagctaacaatattatatggcatttgctatttacctggcattgttcttagtgttttgtatctatagacccatttaatctttacaacaatcttaaaagatagaatgtgtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccgaaggcattactgactcattggttttgagttgacaattattagtatcttagaaaagagtagagatgatttctgagctccataatggagaggtagaaggtttgcatttttcatgtgtttccattgattgttttctcatttctttgaagacatgtggtcctctgtgggcacagcaatgtgggaatcagtattacacaacgggtgtgtgttctgacatcagtcctgattttcagctctcagccagcttctcacctgcaactcagcgtaagttattaatgtgcagatggtctgagcaatgccttacagttaaaggagggggaaaaggttatcaactagtggcacccaaaccctccttaagtctcatttttatatggctgtgaaatatgacttacctgtggaaatctgcttctttcctcttttcctgtgtagcctgcccttccctcatagatgttgtggttgtgtgtgatgaatcaaatagtatttatccttgggatgcagtaaagaattttttggaaaaatttgtacaaggcctggatataggccccacaaagacacaggtatggctaacagaaatgcataactaacttatggctttctttctgaaaaaaatattgttagctatgaagtcttaatttttgtatttgccaaatccccattttaaatgcatttgatggtagtttttaaagttaattgaaacttttactacattgggttattctacctatggctttgcccagtgctggtcttttgaccttagagttctatttctgacacaagcattaaaggtatgggacataacttttttttttttttttaagaccaagtcttgctcttgtcacctaggctggagtgcaatggcacgatttaggctcactgcaacctctgcctcctgggttcaagcgattcttttgcctcagcctcccgagtggctggtattacaggctcctgccaccacacccagctaatttttgtatttttagtagaaacaggatttcaccatgttggccaggctggccttgaactcctgacctcaggtgatccacctgcctcagcctcccaaagtgctgggattacaggcatgagccaccatgcccggccaggatataacattttaatcttcctttagtttcctgtctttcccttctaacccatgagttacattttaaaattcaatatgtatttttatgtccatttggaccaataattaatttcttttgtttattccttgctggtaaaacaattattgaattctgaaatttgtataaataagtcactaagcatagttccagcatttatgataatattttatagttatttatcatattccagtttagcttgcccttttgcctacagaaaaggtcttttcaataattttatatagttctttatattttaagaagtctttaatttgcttttacatcttcttgaggtaggcacctaaagctcaatagtattattttaaagttcagtttctggttttggattttttttttcctttctgattgaatctgccatttcctgagccattctggttgtagcagtatactgaaccagtgtcaacccggaccagttcactgttaccagtgtatgctcatggattgcatcttatactctaatgtccaacatctaatacaaattgttgacatatttttccctaaatgctttccagctatctttattgaaatttgcttctctgctttcctgttcactattataacatgttgttatatgtttctcccattgaaattgcttttcagtaccaagagtatctcaatacccacagaagctttggaaatttccctgtgggcattttccaggacattccgctaaataaaactacatatagcactggtttccagaaagcaccactcttaaagccccttataagttttcatatgtatctccttatttcctctgtttctaaatgagttaccctcataatgtgactaattttatttaagtctcctatatagaattcacagtcttcctcttttgtgtcttcctaccacagtgcatctgattcctctctagaagtggtttaactcaatctcttttcttacagcctaaatttgaccttcctgtaagttctaacctaccacatttctttaaatcttttttcttctttttcacacagaagtcctggggctctgtcgtgggattactaccatcttcctctcgtattggactttgaaattctcagttattttttattctttcctccctctcaagtcttacatccctagagaaaggggtccaggaatattatatttctcactatcttcccagtgcctagctcactgctcccttggcaaaacacagcagatggaactcagaaatccagtcctcaccgcttccacctccttacatactgacctgtatttcagagagcctcttattgccattcagagatccctcactgccactcctgttctggaaagcccatctcctaggcttagaggatgatctcaatgcctgcaaacaaggacattaacagaagggtgtgaccttattgatctctaggattagggaatgctcccaaacatcttgttcagaaattctttcaaataagatgctctccagtggcattttctctgaaagccagaaactccctgccccatatgcacatatagcatcttctttccagtgttgttgaagcccataatagaggaaattcagcacaataaatagacctcaattgactacgctgattaggagcacattggtttttgttgtattcaattctaattatttattacacagttaccatcctttgatgagatgttactcttcatctgtgattgcttatagttgttcgcgagcttctgtccattggtaattagaaagtttatttatatcaagtttaatcttcctgttaaaaacagtgttctaatagtcatccatattaaaatattatatggcagtattaaaaactacaaatattactcttgggaatcaaatcatacactgtagcacatcatctttcttggcaatagtactgctgttgtacactgatggcctctaacagagaagaaatcattccattgaaagaaaagtaactatcaagaacaaagttggaagtgatgccttaaagctaccggcccatgtctaaatgtacttttgatttttattttattggttaagtagaaattatttttaatgtaatgacagcccattaataaatgtctcctctgttgaaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttgagaaggcagctgggaaagttaaatctttgattttaggatatttataagatatcacatgatatttaaatgaatttatgtgaagtaaatgaaatgagaagaccttagattaaaacagtaggaaatggggcaatctgtcataatttgttaatattcatcagagattcagacaaattgagctcatggatcacttggtgcaaattaacaaagaccacagaatcttaaacatacgagtttaagtttattatgcttattacaatcagtgggaaatgtgaaattataactatacaggactctcttgattcttatctcaatttctctattttctcagatccactgacctttcttttcactctattttttattttatttttattatactttaagttctgggatacatgtgcagaacgtgcaggttcattacatagtatacacatgccatggtgatttgctgcacccatcaacccatatctacattaggtacttctcctaatgctatccctctcctagtcccccaccccttgacaggccccagtgtgtgatgttcccctccctgtgtcctcattgttcaatgtgctctcattgttcagctcccacttatgagtgagaacatgcagtgtttggttttctgttcctatgtaagtttgctgagaatgatggtttccagctccatccatgtccctgcaaaccagataccttcacaaaaatgctaaacacactccggttgttaaacaaattaatgagaacaacaagcttgccttcccttaaacctattctctctctttgtcttgtgcattccttctttttaccaccataattctttttgaaaaaagcaactctattccctccctctacttccttgaaacttacagttctgccactagataagcatgaccctcttcatcccccaaccctgtggtcccaccttaaacctcatcctttctggctcctctgaacatttgataatgatgaacatacgctgctattcctaaccaagttgccatgacaccacaaacttctcgaactcctgccaaattcttttgcctcttcactagctccttttcctattttttcttcactaaacagagccctctcttctttactgctcttctcctgtagggattctatccactgtcatggcatcagcagcagcactgttgggttatctcattgctatgttgtcagccctacactctctcccaaaactcacactggcatctagctgatgatgaatatttttatttggagtgttggctcacttaccaaattcaatctgtcccacactggccttattcttttccctaccactcctcatgaacttgccattttgattcatgccactgtctcttgcctagtcagtcgaactaaaaatttggtttcctttattctttccactcttccttatgtcacacatctggtcagtggccacatcctgtcatttctatttctgcatttcccattttatctgtcttctttttctgtgtgtgtatttcagttgctacttccgtcaactggtgacaatcccaaatgtctcaaaagcagattccccacaagagaagatatgattggtttggttcatcattactgtctctattcagggacaataaaggttttttgggccaggccatctcataagctgctggccagtcaataggtcagctgccattaggtgaagcgccctttctggacacagcaaactggactaaaaggacaaagaagttgagatgaaaaatggctttcctggagttagaaactgcaacggcccggttttcagcagggaaggtgggagtagcatttttccctggaaggagcctggggccctggcgagctttgttctccaggacaatggccactgtccattgaggaaggacttgcctggctttcatcatgtttcaaaactttggttttctcccttgggccattgtctatctccctcttcccactatttcccaagctaacaggttttagtctgcccagtgctaggagaatcacccaacattttactcatccctcctagaatgtaattgcctgtctctctctctctgtctgtctctcatctctttctttaaaacattgaagataatctgaaattatttcagtaattgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccgaaaaatgcagaatattttctatgtttctatagtctacattatagaatacaaaaaagattttaggaaataaaatgatatgctcagttttataataaactgaaactcatatgtttaagattctgtggcctttgttaatttgcaccaagttatccatgagctcaatttgtctgaatctctgatgaatattaacaaattatgacagattgccccatttcctactgttttaatctaaggtcttctcatttcatttacttcatataaattcatttaaacatcatgtaatatcttataaacatcctaaaatcaaagatttaactttcccgactgccttcttaaagtattcaagacatagaatgctctgatttttttctttatttgatactatctattaaaatttgaattgtgtgtatcctgtgtcccaataattttactgctaagattttatcccatttgaaaaagtatgccaagatatatacacagggatatttattacagccttacttgtaaaactcaaaatgtcctaagcatccaataatggggaaccggttaaataaaccagtcttccttcatatggtcctccaaataaaatattatgcagacatttaaaaaaagaatgagaccttcatgtatatacatgtgctgatatggaaaggtctccatcaaagtaaaaaacaactgtttagaatatgccctcatttgatgcaaaggcataagaatgatacagtggactctggggactcaggggggaaatggtgggaagcgggtgagggataaaagactacaaattggattcagtgtattctgctcaggtgatgggtgcaaatctcacaaaccaccactaaagaacttatttatatgaccaaataccacctgttccccaaaaacctatggaaataaaacattttttaaaaaagaatatgccctcatttgagtaaaagtttaaggggtagactatgcctgtacctatattacatctaaataaaacattttctagaaggaaatgcaagaaactgataatggtgcttacctgtggagaggggtttagtgtcacatttggtttatacctttccaaatactttgatttttttttaactgtggatatctattacttttaaaaaaataagtattgataaagtaaacacaagactaatgcataaaatttataacagaaatatctttgctttattaattcatactgattaattcaactttcttagaagaaaagaattctaaggaatactgggataaatacatgcacacatatacacacatatgccctgacacacaagacattgtttttaatgtcaagcaagacttccatttgtatatgtttctctacaagctacaaatggaacattaaatatgtcctcagaattaatatggagttacaatagattgtgtttaaagaagctagtttcatgtttctattttaaaccagaggttctcatattaacttcatattttgatagcaagtctttatttaattttatctgccacagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagtaagtggcttttcttttcacttgtcttgccgctattgggtaaatctttctttatagcatcacttctcaaggctgcactttcccattggctgttcatagttgaatataaaagaaagttcttactctatctctgcttcttgatgattttcaatcctgtctactaaataaagggttatggaaatgttgcttgatttacttttccagagggaatattgtgttcaaaataggctagaatgtactcatagggaaaatgtacagcagtaatgactgcacattctcttcctctattttcaaggttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtaaaaaaaataacctcctttcaagaattttcttcaaaatgtttaaataattgtttattatcacatatttgctttactaatgttaacttgtataccatgtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatgaatatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcacccaaatcctagttcttgatggttaacccgaataactctttgcaataaagaccatatgttattggaaacctatgtatcaggtacagccttagagtctggggctaaaggaattgcataaattattcattcatatactcaaatcttgatttgattatccattggaattacccaaaaagcattattgcttcttcagtatcccatggtgcttcaaagttgtttaaataaccatttaaatccagcataccctgagataacacaaaatcactaggctatccacactgataattgtatttgtttgtagtggaatgaatgagaacaattgcaatctacaagctagctagaaatgattttgagcattatttgctattatggactttggggaacattattctattttattaaaaagtatctctactcatcctgtgtaaattattttatcttctaaataagactatgttgtacagtacagtttgtcttcttttctatattaaagtgtgagtccagtaatttagcttccttttgtgaagattagtgaaacgtagccattttgatcacactgtatggaaaataagtaccaattgcatcttacagtgttagtgacacaggcaagcacatatacagaaccagaacaaacttcccaattggtaaaattcctactcagtcttgaattctgattcctaatagctaactcagttatctcccagcagtcttcactacagatcaattgcccagcccttccaactgcatctgagatatgtgtacattatcagtacccatatttcaaagctaaaaattcagttagtttcttagctagtaatgatcaagtttttaaaaaattatcatctcagttttcaccttaccttataccctttgttgagtgtcctttggtatcaagaacgtcatacatattctgctaaatacattaatgttcaattaaagttaatgccaactttgaacactaccttggaagtgttgttatttccataacctgctagaacactttcttagtaatttcttcttcccagaatatgcaagctctgtatttttgggtgagtattggaacagtgtgtgtttgtgtttgtgtttgtaggcatgtgtgtacatacgtgcctgcttgtgtttgaaaacttgatttaaaattactgacagtaatacaatttttaaaattgaatgttccaggtactgttcaaggaggagacaactttcagatggaaatgtcacaagtgggattcagtgcagattactcttctcaaaatgtgcgtatatcagatagcttcaagccatgttgtcatttggcataacacttccagacacagtagccttatacataaaatgggaagacagccatctagggatcagcccttctgattcctagtcacggtcatttagtttctttgtgctgctgatttacctctaaaatttgaaggataataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatggtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatctagaatcaaaggaactgactttttctggatcatcaatccttagagatgctcatagaagttatggatctttccctcagaaaaaatgtaaatgaatctatgcacggagaattttgcacacaatcccatgaggtttttgtacatacgctgaagtcctttcatgcaccccaaatccagagtccctcaatttactacagtcattcacataacttcatggtctcttatcctcaaagtagaacacatcttttccttacttgctatttttcatggcttgtattttttagtccaacatcttatctttggtacgctctaagatagaagaacaaaaaattaaaaatagtgtatctcatcctcaccaaatctgcctcgtttgatgatttatagcattgagtgtttagattgggtttcaagtcaatccagagtaggcatcttcctttgccctccccacagggctgacaaatggttattttccttccaatagattgaatgtcacagctaaagttgcctcttgtagctgtgctattatcaaatagatggaatataggaatatactggaacatttgagaaggggtcaggaagagagaggaagaaagctgaaagtagaacaggtcagaagagggcctcccgagccgtgtctgggatagcagaagtatctccgtctctcccgtgtcagtacttctgtttctcaagcatgtctcatatccggctgtgagctttccttataaatatgtggagtgagagactcacttctgactcctttgtaaagttcataagggtttaccattggcaaatatatgcctttgaaagggaaatttgaagatggctctgtacctgtcctgtactacaggttattacaaaggtttgtctgtataacatatcatactaaataaagtccaaaataacacagccaatgggaaggcttgttctctagcacaaatatattaagacaattctacaatatgtcaatatatgttcatatatatttcatcatttttaataaatctaaacaacttatttcaatgttttgcctaccctgcattcttatgttttaaaggtgatttgtttcaatgatcttcatttttcaattattttaggatattctgatgctgggtgcagtgggagcttttggctggagtgggaccattgtccagaagacatctcatggccatttgatctttcctaaacaagcctttgaccaaattctgcaggacagaaatcacagttcatatttaggtaaggcatggtaataattggctcagcaaacttaagttcccttgctttaaaccagctctttgttgaatctcagggtgagttcagcaaaatccttgaactgtcatctaattatcatatttattacacatacatatgttgtctctttgccaatcgggccttaaggcataactacttattggaatactatattatactcactagtttcttctggctggtcaagtggttgtaattcctggaacatgattgtgttcctccaaaatggaaatagttcccaaaagtcaatacagtaagtgatagtcttatagtattttagagctcttagtcttcttgttcttataataagcagccactgattttgcagacttactatgggacagttcctgagctgctagtctatctacataaacatttaaatctttccaacaagtctttcagggatgttttgcctttgagagatagcaagattaacaacttgtctaacgttcaacaacctagtaagcggcaaatccagaatctgaacctcagcctgtttccaagacctgtgttctttctactgtgcaacactaccttttaaatacatttattcattcgttcaagaaatattttttgaatgccaggttcacaggtggctgatgagaacagcgtggaatctagaggcagttttataggtagaagtcccacctgcaaagggaagtgctgcaggtcaaaggacaggagcaattcatcttagaaaaaggaagacatgtcctcagtgatgtattcaggagcactagaaactttgcatcacatctaacacaaaaggatctctggtcacctttactcacttcttttaactttattttgctcagatagtcaatgttaatcactctgttgctccttcccttttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccaggtaaatctcactgtttagcaggtgaaattaattttaggggcaactgggcaggtggggagtcaggtgaacagaaatggaaaacaacatggcctgagtgcctactctgtgattggctctgtaatctgagtttacttagtgtattccttaaatcatcacaacaataccaagaagacagccctcccttttgacaacttactgggaatttagctagctttctaaggtcacacagcgtccatggattgagctgtcattaaaactcagtcctttctggactcagaggctgtcctgaatgattacatccccttcatgtttttgactccctggattaataatgcatggatattatttagttgtgatggcaggcatgtaaccactgctttgtaggtaagcacacactaggaacaaggatttggagaggaaataatgagaagaagggagcagcacaacattataaggactgaacttttacatctgaacctgtcagaatgtcctgttggttttgaagattctaaaagtaaaacaattatcttctctgccactttcagctgatgggtgacagtttggtagttagaccctatgatgaatcccagatatggcccactacagcaaagatctgttgctagagcaaaggccagctgattgcttcctgtttccttactaaacagttttgacccaggggcttgacacacatttaaaatgagcatcactaatccctgacaaccaacaaaaagtggtttccttctttaagctggagaaacttacaaagatttctcttctctgagattaagtgtgatcctgctgttcctatggattttctaggagtaagaagacccgagttcttgacttccgtgaccacaaattagctatggtcacatacttttctctcttttttaatattttaaagaagttcttctttaatttagaaaataacagtgacagtgttatggaaggaatcatttcttagtcatttctaaatcctcaaaaagtgttcacataggcatgcattgaacgttgttgaatgggatgaaggttcaaagtctcagcttttcttattttaatttatctccaccttgtcctcctgtcccaatctatccagcaactacttacctgtctcatatcatgccatgtacacttacatcatcatatgtgctttcccacttccctctgcctagaaaactccatgtccttcttactttgcaatttgaatgatattttaactttctaagccttcctgactctcctgctctctgatcactcagcctttgggacttgcctctattacaatttattttactatagaagcttaattatttattctccctgcctctacccctcctgccttttgctatgacaaacctcacatacctacaaaaggtttgccttataagtatgtctttgaccccctggcatcagaaacacctggaatgctaatttaaattgctgtgttctggatcacatcctagacattacttcagaatctctagaaatgggtctcagggatctgtatttcaaaggcattttcttggagattcttgtgcacactaagatttaagaaccaggtgttagatggtgttagaacctgagggaaggaactgtgctctctgtcttcatgttccaagcactttgcaaatagtaaacactcaatttttgtgtattgaatgagcaagtaaatgttcagtgtaatattagaagtatatgaatcctaggaattctaagtttaacatgttttattactccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagaggtaaaaaaaaaaaaataaactaatagtttaatttgctttagtactggtaatttaacttgcatttggaaagaaaaatttattattattgaatgataatttgcacagatagtatggtttacatttcatcatttttgaggatgtccccattaagttatgattttaaaaatcacattaacaggaaaaactagagttgaatgtatagtgtactgccattttccatgagaggtctttgaatatatagtctcttatgcaaataaagccattataagtgcacatcgtttattgaaatatgcacacacacaaacatttgtgtatttctctagtatcacatgtaattttttgcgataaagacaacaataacagggcaatgctttcttgttatcagttgacagtgaaaaacagaagttttaccaagcactttgtaaattccttgtgatctcagatgcttcctacattagtttgtcaggaagtgtcattgcttagtgtaacatttaggcatgtatccaactcttgaagtttcaagtccttccacaaaaaaacaccatacattaacatggcaaagcataatttttccaatttgtggactgaactctctaaatccatgtatataagtgtagtgaactccatgaaataaaaaaagaaaaccaaattaaaggcacagattgacatagaaaattatatgctccttagtatataagaaaaggagaagctgatgttaaaatagtaaatactatgtttaagtattgtgatattttgtaccacctgatttattgatatttatgtaaaaattaatcttttaacagaagtaattaattaaaacaattctaaagcaattatacatataaagaatgtgtaattgagtatcaacaaaggctggacctagttacttgttgaaaaactgacaaatccccccttctttaaatatttcttacttgtgagatatactgaattatcattaattgttgaaaatgaacagatcttttaataccgtgtcaaacgcagtaaaaatttgtataagattatattagaggagaaagaacactgacccagtttcatggttgagaaacattgctttcttgtgaagtcatgaaatatttccatacttgatcataaaattgaagaaaaaaactgtgttttacaaggaaacgtcttttcctttgcacagaattatttaatgtttttaataatggagatattaacaatctcattttctacttcctgtaccactataattatgtcactatttggtaatttttacagaaagcctaaattaagatattgtgttttattttgttctgtgtctgctttaatttcattcaagatattagtaattttcaccagaaaaattttaaatcaaaaggttggaaatagatgaagatcgtattattgagaggaaaatgagaccaagaaatggatgctgttcagctacagtaaagagaattatctcctttgaccttggtttatgagcagatatttatgaccttactgaaattcttatttataattctgatcataaatagttcaggtttaaaattctatccatttttaatattaaaaaattagtttggtcatcgattgctctgaattttattttcttttttattttatcatatttctttcacttttttaaatagatggggacttgctctgtcacccaggctgtagtgcactggtgtgatcatagctcactgcagcctctaattcctaggctcaagcaatcctcccacttcagcctcctgagagctaggactacagctgtgtgccaccactcctggctaactttttacaaaaatgttttatagagacaaggtctcactattgctcaagcaggtctcaaatacctggcttcaagtagtccttctgcctcagcctctggagtctttgggattacaggcatgagccaccacacccagctgctctgaattttaattatacaagttgtaaggtttgctttaatcatccttttgtttcccctttgcaagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccaggtaatccatgagctgttatggtgatgtatgtatttgtgggtcttatcatattagacatagaaagcgtcatgtaaaccatgcaatccgtccgccttattttgtaacttcattctttcactcagcaaatataaagtgagcctctactgtgtgcccaagcactgttctagagtctggggatgctataagaacaggacagacacaattctgatctttgtgtgccttatattatattggaggagacaaataaaaagaaagaagtagataagataaagtattccagatagtaataaaggaatttttaaaaaagcaaatgaaactaaaataggaaataaaatttcagcaataggagtatcaggtggttgaaggggtgactaatgaggcctcactgagcagccaattttggagtaagactggaaggaaaagaactaggaaattaaccctgtacctgaacttgcatcaatttgctccaagtccactgatcttttcactggtttatgattttttattaaagatttatgctgtcccttcgatgaaaatgtggctgtaagagtgatgcagagatcagataataagatgtgattaaaaaatgaatctttagaatttgtagagaataaacacaatctgggacattactatatagaaaatataataatgaaattcagaggctgccattttctggttcagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtgagtcaggaagagccagacacaaactaactaaaaattacctgctaagaaagcagaacagatgtctgtactggtattatagaaatgccacatgcattctataagactatagggaatcgatgtatcatagtttgcacaaaggaataaatgtgtttttccaagtaggaaaaatagatatatttgcttaccattagaaatatagttctctcctcatatggtgagtaaaacagtacatagaaaacataaagttctggaaatggtatccaggctatttctgaatgttatcttcctataaatagccttatctcagcatacagaagggaaacctcatgagagtgcattcaaaaatactgaaaattcagaccacacaagtaaagtgtaacttctatgtgactgaatggtatattttaaaattattagtcataaacaataagccattatttaggtttagctgacctctcattgacctccacaggagttgaagattcagagagaacagtgtgaaggtcatgtgattcaaggtcaaaaataagtatattgggccggcaagggaatagaatcagaaagaagttgtttattcaatcaagaatctccattcatttgtctctgtcaaaaaatgtgctttaaatgtacaaatatttgaagaacagaaaaataatattcattgattattttttatttctgagtttaatgatactatttacaaatctcacttgtgcttttaaagaatgaagtacattatttttattgcagaatgaaacttttatgtggaaaaaataaaactcaagaataatacttaagactttaaaaaaacaagaaaatatatttactgaataaatcagttaaaatcatttcagagtagcatatcaagagtaaatacacatatcccagaacctaaagtataataaataactaatatgttaaacatgtattgtgttagtgatgcagtcacaaattaaaaaaaaaattatctctgtctgccatcttagagctttcaaatatatactactgctaaagtgctttgatagagagtagagagaaaaattcagtaatgctggtactgggtcctctatgataaaggatataatacgtgtgctcagtaataacatccatccatctgttactctttatgtcttttaggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtgggtgcgtagatctgaaataatctgtatagaaattggttggcttacagagttttagtcctgaatataacatattttggtttgtaggccaagagaaataagggttttagttatagacacttaagtttccttacactggagatgcccgagaatggttcactagtcatggaagatttgtttagatcttccttccacatctctagaaggttctgctgcagaaagttgtaatctctatgacataaccaagggccctcctgcttccatcctttgagtttctcttacctccatttctcttacttaaaaccttgagcatacacagattatgctgaactgccactcaaatgactatatcatgttggctatgccatgatctatataggacaggttcagtaaaagtatcaagtatttttcctgtcgttgaggaattaataaacatgaaataatgaaagaaaacatgaaaagcaatatataacttttacccagtgttttaaatgttctaaataatacagagaaatgagtaaaagtctgaattatgtctcatcagatggggaaggatgaggaaatcattgtgggcaagcatcagcaggaattgttgtcttttctcttgggctggccaagttgtctttcaaggcctggcagaggtcctgcctcctcttcaaagctttttctaagcacactatctcaccttcatctcttctgccccaattatctcaccatgctcaatgcatagcttgcaatttaacacttgattcaaagctaccttctttcattaactgctgcttcatgggtcccaattcccattccgtcagaatttggctttaaacttcagaacttgtagttcctataggaattcaattaagtgacaaacatattaacttaaagctgaaaatacagaagcaggttatttgccataattcataccaagatacaaataagatgagaacacaaagcaaaattagattcaaatcttaacatgctttccatattttcctacttttcatatccatttggaagttttccatgcagatgttcaaagattgacccaattttgagtagcatatgtcacttgacctgccatgtagcacatctaactgagcacacatgatagttaagtcaaaaaccgttgctgcataaacattgtggctagtctgcctaataggttaacttgggaaatatattatttggcagaaacagcaaactggtcagctcttctggccccgaagcatagaggtgtctcatgtatcttccctttttgactatacttcaacccttatggtgatgcacactcaaaaattctactttcagagaatttccttcccatccacaggctgccgagggtttctggcctttcttactattgggcatctttccctttaaatcttttttcctgatgccttcaggtccacaaagacaagccaagtgaaatgattgtgagctcatttgtcacttcattgcttggcaataatagtatgtaagacgtgaatcccatcttcacaactgtggaaagtgaatttataaagcatatggtttctatcatttattgcatcaggtgcacacttcactttaagattaataacatagcccatgaagcgatgtatcatttttataaagctgcttgaaaaaaaaaggaaaagcattataatgtggactaactttgtcctaactgcactcacctccttgccattgtttttcctttacatcatcttcacaacttatttttagtttatttaattctttaatattttatctatctttgttggcattgttaagtcactggagcaagaaaaattgtacaacatatatgatagatttttttcaaggtaacatgtagaattcatgttttgggaagtatatacaacctttaaaatattgaaaataataaagtaagatagaataaccccaaataaggcaataaggcagctgatgctgtgaatggcaccaggtgttctctctcaattttggacacacggccagtggactttagttgaaggtaataattctgatagtttagacatcggctactgacatcagttattatcacataattttttttcatgagttggtattaggaaacagaggttcaaagagggtaagtaaattgccccaagtcacagagctcataaacagcagaattaggattcaaaccaagtctgcctgactgagactttattgctgcagtgttgcatgcatttccctatgtgagcatctagaataggtcaagcactgtccatgttcccttagagtatctcagttaatcttcacaataacaattaattcttacaactggatggaagcagaaagaatatgagctcttatttcaaaaatacccaacttttacttctgactagccatgtgaacttaggtgaattattttacatcacttattctagtacattatttgaaaaataagataataaaattcactttccagattcattgtaaaacttgtatggcatacatgagaatgtgtccagttgcaggcgctcagcaactgttcctttccattctgtgtctccgtgttatgagtaatgaaacccgtgcttgtgggagtgagcaatttgcccaggttcatcacagtaggtttcctggcggcaagtctagtttcctttccactgctcccagccacatttctctgaatcacatttctttgtatgcacagtcacctacgtcacatcagagctagaatgacaaatgctttgtggtgctagctatggttcacaagccaccaatatgaagactatttccatattttcttgatgtgagatactttgtccaagaagacacaataaagcaaagatgctttttcctataagttgatttgaaataacatttctttatgattttttttatcatagccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggtaaggcctcaggaacatcccttttgactttatttcttcctaaagacgagagagtggtaaaagtcaaaaatggaagcttatgagttagaaaatgctcacccttccaatgaatgcctttcttatgtaattccataaataagaagcatatttactttatgctaatatttatggtcacaatctattatataagtcagcaacatcaaatttcatttagaattgcaatgaaagggctaaaaatacaattcttaaagaaatcatagatacagtgttttcttaaatgtttaacagagagaactttccattggcaataaatgttattttgatattttcctatcagggaaaaattttatttattgttcagctactgaaaaataactccaattgtggtttctactattagatttaagttaacatagatgaaatatagtagattatgagataacaattatttgttctaatcgtatgctgtaattactgtatttaacatggattttgaaaatttcccaagtgagaaaaatgcttttcaggagaaaacttccagccggaaatttattttataaatgatgtgaatatttccaccttggaaaccacataatggcatttgaaaggataatttactcaggaaatcacttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcaacccaaatatttctgatgtaaatggatggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaagctgtttttctttaaagtttaaaaaaacaaaatcctttttcactatttgatatcaatgccagttaaagtacatcctacttgctaagcccgcagccagccaaggaaacatctcctcatagtccagagctgtcatggtagacaggcccccagaaggaataagtccttctgggaggacttctgggaggcccccaagagttaagagtaagtcctgcctgtgaatggactaaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctctaaattgtaaacacatttggaatcattttcttgttttaatgttgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgcagcctgaaaattcttaattttctaaatgaactacaattacatatgcataaagttcactaacacttaagttccatgacagcagggatttttgtctttcttgttcactgctgtgtttccactccctagagcagggcctggcccattgtatgtgttcaatatatatttgttgaataaataaataaaaataaagtaaatgccttgtgctcatactcaaaaaatattaccaatacatatgaagctctgcgtatagctgtccccgccatagacactttcatctagctccccctgtgcaaatgattatcttgaattgtgtgtttattaatgcttttctttattattttgttaaacatttatatattcctagaacattgtttggttttgtactttatgtaaatagaataatattctatgtattcttctgtaatttgctttttcaacccaagagcaaatgtatggatcttttttcctttttcgtagattcctttccacaaagactgtggtgaggacggactttgcatttctgatctagtcctagatgtccgacaaataccagctgctcagtaagttttactttaaagcttgttgtaaaatgtagaaataaaagacatactagattactttattcaaacgaatgtttatagagtttttctacaaaagaaacattcataactcataaatacctttaaaaactaaatttcaatgtctaccatccacataggagtaaaacaataagaaatataaaattatctgtatttaaatggttccattccctctaatacaatagcaacaaagaacaatccaattgcatttacttatttgttgtcagtatcattttgatgcaaagatagtttattacacagcaattttctcagtattctaagtaagtctaaagagtttagttttttaatgagtgaaattttaaaatactggcctttttatttaacagtaatggcttttcccccctcctttttacttttaacagagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggtatgtgatgagaccctgtacttacttccaccatgcttcctacttatagatcactgtcttctctatgtcctctgagttgtttaaagaagcaccttaaccctcaacatgatcaatctgaactttgtggcttccgactagttaaactgcatgagaacatagtctggctctatatctagattctgcttgacagcttgggtcagtttttcccttatcctgagacttggcagcagtagccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatgtgatcttaataggcttagagttctaaacctaacctgaccttggtgtttaaacaccctgtgccaagtggcaactacttcctttaaagggaaaaaaaaacctgaagaaaactaaaaaaaaaaaaaaaaaaaaaaccctcaaattacttaaaatacagacaaacaccaacatatgattttactttcttctcttgaaaatgcttcaaataaattgagaagaacatattcctaaagccagcatttcaaaatattgaattaaagctattcgtgcatctgaaaataaaaactatcatttttttctggggaaaaaatacagtatttaatcttttctttgttttgttggatgttctaggtatctttagggttagcaataaaagtagtatattagccacctgggcagtataaaatttcaagtcttgaggtataataaattatttcagtatgaaccaaccttactgctaaaatgccactgtacctcttttaccaggtgcgtgcatacacacacaaatgttgtatgccaattgatcattgttgtttccttggtcttgttcaggttgatgggacagaagtaacatgccaggtggctgcatctcagaagtctgttgcctgcgatgtaggctaccctgctttaaagagagaacaacaggtacaacttgcatttcatcctccaatccatacaagccctccttagcacatatgctaatttaccaacataacatcttgctatcatgatttgataggcatcacaaaataactagctgcatacttaggggaagttttcaatatctaaatgttttctttaaattattaataaaaatgggattttctccatgcaattcattccaaaaggtacacatactatggaaagttctttttgtctaaatatgttgagcaacattggtcaaagcactatacacagagtcacagagatcatttattaacccctagtaacaagtttcacatcagctcaaagcttccaaattcagacaggtatatacgcctggataacttacatgtgtcacttggaagtcaagcttctctaattctaatgtgaggcatagtaaaacaaggtggacaaataaagatattccacaaatttgaaagcttaaggtatataaaattcagaatcaaatttgagtgagtttacttttatgagaaacattttttttttcacgttggcctctgagtatgaagcatcatagactgagaaattttaattttgtctttaggtgacttttactattaactttgacttcaatcttcaaaaccttcagaatcaggcgtctctcagtttccaagccttaaggtaaaacataatgaagtcatgaatggaatgatggatagctttgtatttctctttaagtaatttcctaatgtttctttctatagtgaaagccaagaagaaaacaaggctgataatttggtcaacctcaaaattcctctcctgtatgatgctgaaattcacttaacaaggtaggtgaagcagtgggtaacctgctatcactgacaccaactctagatcagaagatttttggctcatggctaaagaagtcctctgtatgctcattcttaactgaagaatttgaattaaaattcttgtcaactaaaacaggagtccacagacatattggtccctaggaaaaccttgagtgactcgttaggcttattaaaccaatgagagtagcccagaaaggcagagaaagatccccgtagccacacatcacaggcacactccacattgcaggccctctgagtagctgcaaacattctcaaaatgttgaaacagaactctcaaaggtcctgagagttgtcttcactttcttctcactgcctacttcccattgtatgtgagatctcaagcagtatccccattcctggacattgaagccccaagcacaatgttttgcacagagtaggtccacaataaatattgaatctagtcactgtttgaatattcaaatattggaactagatcaagtctagtttctgagggaaaaattcctcacatatcagattagggttttcttccagccaggtggaaatgaggttttttccaaaggatgttatccataaagaaatgctttgttccctgtttttacctgcccaaagcaagcaaacctgagagcagtggtgtaaatgtcactggttgatacaggctgtctttaattgttcagagggacaggtgtcttggtaagtgggtaacacacaaattccacaggttctaataggtcgatatcactttaactcacacttagaagtaaggtgagttcatggcacagacaaactggaacacagttgtgcagatgcactgggcacaggtgatgccctcctacaggcctgggaaccagagttctctacctggtgaagcaataggacagcttcccagcacagatcaatgacccctgaatagcacactgcagcactttcccaagaaatccagtgacagcaggtttgtctaacttctaccacatcactccagcccctaagagcatggaatctgtagatcatccaatagctctctgagcaaaaacaaaaaggaaaatatgtcatcatgtctagagcttgagccaaacagcaaagatgaaaagaatgcttctgtatcaagtgagttgcaaatagcacaagcagaaacaaaattccgtccaaataatacatctctgaaaaagtcatcagtaactgcagacttcaaaggatccccacttgctaaaataagaaattggaaacaaatgcaaccaacccaaattgatgttaccacattacctgaattttttccttcttatatttgatcctttcttctaaatattttttgtcaatacagtctttttattattctactctcctacaatggccaatattttcccagatatttaagaatgaaataaatataagattgaaatgagactttacttttactaattatcatcttaggcaggtatttttgtaatggcaacttgaattcaaatgtattctaatgttctttaaaatatatcctcaaaaaaattaacgtagggaattataaagaacaaaagttaaaatgggtcctagtcctactacctagaaaacccaaacattggagaaaggtagacagtgagaagtcatccctccccaccttccctagtgccactccccataagagactgttttcagaatatcttccagatacagggttgcttatctaccaggatatatgcatgtaacacacacatacacatatatatacacacacatgtgcacattttattacccaaaaggaatgataaaacactcttctgtaccttgcattttacataatcttagaaaagttttcatatgaggacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcgataatagtattatttctgaagcaggatccccctgagtatagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaatacatccactcaagtctccctgtgacatattttccttttaaggatatggaaaaaatcattaaggcataaaagagggaaagacaaggttttagtaaagaaacccaaaaaattctacttcagaaaatatccaccccaagtttttaagaaatagaatcaacattctataattaacgtaaattgtccagtgggaataaatggaaaggatatgcacagtgttctcagacccctaccctcactgctcatcccctaatcccccacgcaaagaagctaccctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggataggaagaacgaataatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccacaaagaaatatgttttcaaaggaatttatgttagtcttagaaacatacattggacgataagcccataggcaagcatttctttttatttggtgcttttgtaactaaaagtaaaatttactttaacctaagctataagatacttaaataaaagaaatattaaccttcaagaacaaaagcaaactaaaatatttggctttacaaacatcatccaacagatctaccaacataaatttttatgaaatctcttcggatgggaatgttccttcaatcgtgcacagttttgaagatgttggtccaaaattcatcttctccctgaaggttggtaagcctgtcataaggatggcaaatccaggagaaagtgagaagaaaaaaaatgagtctggaaataaaaggagaaagtaaaaagaaattgaaagagatccgtggttctcaaacttgggtgtgcattacaatcacctggaggaattgtgaaaccacagatgctgggctttatctccagcgtttctgattcagtaggtctagggtgggcctacacatttgcatatctaacaagctcccaggtgatgcttatgctgctggtccaggtgccatactttgataaccaataggctagatcatagttaagtaaacaactgggctttgtgcatagttatgtgtcttgggtaagggatacttgatatattttgaaggcaaatgttcaacattaaccaacagagcattactataaaggaaggtattgctgtgggtaaaagtctttggcatataattattatgccaatttatcctcagagaccacttctgtttgagtttaccatttgtatacaaatctgtacagtaatactaggtagtatctaaaaatatttttgaaccaaattctatttactattagtaagcgattattaatctaaagattactaccagttaaagataaattaatttgtgaaagaataactattttatattgtaattaaagttaaagaaactttggaaagtaaaaagaatttatccactatcctaagccaataccattttatttttgttcatttctcacttgtttgttacatggttgcaactctgcaattttgtgataaaaaaaatctttagaagaatctttatgatctagatactacaatagaatttataaaatgtggatggtatttggcaactacattctttaatggggcatctattcaattcgcggtaataacattcatagagtgtgtaataagtatacaccagccatggtatcaagtgctttacatatgttatcccatttagttcccagatcggttatgagcttggtattattattcccagggatgttatttaaaatatttaaataaccagtagtgtatgagccctggccaattagaacagaaacccccacccatgagaacagatgctgtaccagtgccctgtgccagcacatacatactgaatttctgatcatctttattttacaaataagaaaagcatagagaggtcaagttccttgcccaagccacactgctaatcagcagcagactgggacacaacactccggcagcccagctccacagatggcatttttaaccatttataccacatgtctcacaaagtcacaaattacttacccattaacattgtagatgttgagtttttttccattgagccatttatgcccagtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggctgactttcatttggactcagtcttaccacctcgtagttgcccttcatcaacacggggttactggtgaatttccttgcatcatgtacatcctgttgcagtactggcacattttattctctacataggtaacaacaggaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagggtgatcatgtctgacattttacagatgggaaacagatggtaactcctatgcagcctgggtgccaactgactagcagttaatttcatattagaaaaaatattgttacaagaaaacaaatggctgagtctagggaattgcaggtggcagaaattattccaaaaaccccattttggcctggtgaagatctgactttgacaggccctgtgaaggctgggaggtaaggggctggacctatatggggagcatagcaggtcttcacagctgtgataaggagctggtcttcaagcagccagcctggactttcgcctggtaatactcaaccctggctgttcattttaatccctctgttcgctcttttaaataacagtgcccagacctaacccaggcaattaaatcagaagctctaggggtaagattcttacaccagagtttttctttaaccacccccactccatccacaccatggttctaacacgcaacctgggctgagaagcgctgctctagccaaacctcttgacattggctcatcttcagtccaacagttgtattattcaacagttgtattatttctgtagtgtgcataggaggctacagaaaaatcaaaatcctaaaatgttccagagaaaattaccctgaattattcacagtgtttagctattgcagatttgcctcatcatatgtgggctataaaaacctagcccacctcatcagttcacatcaggagcatttaaatacttgatgttcacctagagattatatgaagtgtggccaggtcagtggcgttgaaagaagcctaacagcccttcccagacccctacaagtgacagtaggatttcctaacatgttgaaaggaacatcataaactgttttgcttctgaagtctgatcgggtgttcttcttttataggctggtgacatcagttgtaatgcagatatcaatccactgaaaataggacaaacatcttcttctgtatctttcaaaagtgaaaatttcaggcacaccaaagaattggtgaggacaagttaacgtgtgaaagctcccctcattcatttatttcacctgtgatcaggacgctgcttttctcctaccagctgatatcatagagctttcttattttgcctttgatgcttatatgagtcaagatttagaaaatattaggttggtgcaaaagtaaatacgattttgaaacccacaatttacgtttgcaccaacctaatatgtggtcaaatctaggttactggaattatcttatgccacttcttacaaaatataagttccagactttatgacatcagaaaaactcatgtgaagctattgtgtttatgcgttgtgcactttggaaacaaggcaaagagctgtgaaggaactagctgtgtgctacagaggagaagccccttaaatcccccttccacataatactgatgttttttatttagctgtgaaatatgctgctgcacttctctgtttttcaatattttgttatttcctgttctcaagctatgcctgcttctttgggaaagagactagtctagcatctggcatggtgctcggcacatattaaatattcaaataaagtaaacctttagtaagcaataactcctaaacaaacctcagctctcccctatgaacaatattggaattctcctggttttctttaattgcagttgttttattttgtgaaggatggggaaaacaggaaaccagaagaataaaattatttcttttaatgtgtattaatctacaagtaggtaaatgcatgctgtaactgaagtgggccacgctaccttttggccttgaacataggccaatgtgtcatagattttcaattaatgacttcattttttaatgcagttttacattcatggaagaattgagtggaaagtacagaagttcccatataccccctgtcccacacagcctcccccactatcaaaatcccgcacaagagtggtatatttgccacaatcgatgaaactacattactatatcattatcaaccaaaatccatagtttacattagggttcactcttggtgttgttaaaatccacgctgtggaatttgacaaatgtaaaatgacatgtatccaccactatagtatcatacagtgtatattcactgccctacacatcatatgtgctctgcttattcatcctgcccgccccactagcccttggaaccactgatcctttttctgtcaacttgtttaaaaacctagggagtctataattaggtttaatgacaaattgtagtacattttgtgcatgtttactaatttatttaactagtacattgttgctaaacaagttacagttttggggggggttggtttttaggtttttttactcttagaaatagtagtgcaataaacaggcttggggtactttgttccacatattgctgattatctcctgaggctatctatacagacaggaaatggatggggtaaagagtgtgcacttggtacattttgagatatagtcccacaatcccttgaaggagggcgggagagttagaactactaatagctcatgagattgcctgtttccctaggtgtgtcccagcactgagttttatctagctttaaaattttagcatttattttttaactcttactaacttgctctctcttttacctttgactcaatactataagaactgcagaactgcttcctgtagtaatgttacctgctggttgaaagacgttcacatgaaaggagaatactttgttaatgtgactaccagaatttggaacgggactttcgcatcagtaagtatcagttttatttgttagatttatcaatagcaaggaaacataagtctgcactgacaagttcttcccctttgacaaaataagtattctggctaatgtctgcaatggccaaataacccagagcattttaccctgaaaggcagcacacttccatcgctttccaatgcccatccaatttagcagtgcctcagagtcatctgggatacttgtgaaagggtctgtttctcagactccatgcgacctaccacatcaatgggaatggtgtcagggtcatctctgcggccctgggctacaaggggcagcctgctttgtccccctctaggggttcctccactctccatcttcccagtctcctgtgccacacccaaatcaaaatgtctgtgtctctgtctcactccttgagctctcagttaattgtatgattgatctcaaaccacctagtagatgaatctagcataaagatatgtcttcctatattacagccaggtcatcaccctgctctcctgttttacccttttcctgttgggagagcccagtgggcacatgactttctaaatcatctcaatccccatgaaagtttgaagaaaaagccaaaacaatgtcattgtttttttccatatggcaactgtgagtctgctctagttatatttgctttcagcagggattttggtagctagaatttcagtctggcatgaaaaaatataaggatagacaggcctccttaaactggactgcttgtgtggctagcattccttttactgacatgggctccaattgaggaagaaaaacagaaattagtctgaaacctcctggggatctttgtagctcttactagattttttttttctttttaacaaataaatcagttcccaaggtgcttacaaccaaacgctactcatttttttttctgtttatcatttcatgatctctccaataaatccacttcctgctatagagttttgtaaaactggagaactcagcaccctccaaactcatccctggagtcaaatataagcaatattcttggacaaagacatagaagaaaacggaatagtaaaagttagaacaaaatgcagaattgggggaatggggaagtgaggagttgaatatttcttctggcttgcttgcttgcttttactttgttttcttgttagttgcatttgctttcaagtcttcaggacaattctaggtcctttaagacgtgaagcgtgccgttagttgttatcaccttcccagctgctgcagtgtggtgctcagttttgctccattggttcttggctccttggatttgaggaacaaatgttttcatagcaaattttgccaactggaaggaacactgactgttgcacatcaaaatgcacacatgccagctctgtaaaacacatttggattttcttgagtttaagactacatcactttaactgtgaaactttttaaagtaccttcccaacgatcttcagaagcagtttatttctgggagtaaacttcctagaaagtgtagtatttatgctgctttaatgtggctatggtggttaaactaagaaaacacccttgagatgtcaaggtatgtcaagtgacatacaaggattgtgtcaagtcctacatatcttcctccttcatgaaaagtcaaatgtttatcctcaccttgcttccagcaatttaagcagcaaagtggatgtttctcagaccacttaggagatccagtctgaaatatggatctcatttcctgtatttgaacccattaatgcactgccttttgttgctaccctttctctgatgtagtgcaaggcaacttaacatttcaagtaatttcattacaaagtgattgatcagggctccaaattgatgatagagttgctgccatttgtagggagaagccttgttgaacgctagcaggtgcgttacttcactctccagatgtgtgtggcatgcttacctctacttgttaaccctgcaggatattgtatgcctgtgagaagggcctattttgagaatgctataagaaaaattctttcatctttagtctttggggattatgaaaccagcatttacttaactgctgctttttttcttaaacttaaaccattatcaatactcttaatgtttcccccaataatatgtttaagagactggtgagcatggttaatttctgatccaatcatctatattgagaaaattaacagtaaccagagactgagccagtggaaaggaaataaattgctcagtttttggaaatacattctttctggctcccagatattgtttagcaaattacctcacagagtatgtccaataatgtgccctagtaaccagaaaaactgagtcctagtagccacagcatgtgaaagcagctctaacatctaagcgctgcattccgcttcacagtagcatcagacctaatgtagagaaaatagtgaaatatacacatcaataatgtttctattgaaaaaatagacttttttttttcccccagacagagccttgctctgttgcccaggctggagtgcagtggcttgatctcagctcactgcaacctgtgcctcctgggttcaagtgattctcctgcctcagccgagtcgctgggattacaggtgcccaccaccatgcccggctaattttttatattttttagtagagtcagggttttgccatattgaccaggctggtcttgaactcctgacctcaagtaatctacccacctcagcctcccaaagcgctgggattacagatagaagccactgtgccctgctgaaaactaggctctttttctgtaactagatggaggaatgaatgtaaagttatttcgaattagtaagttaccagtgacatcagcataaaatatccttcctatatacctgccccaaattaagtattatttgatagaaacacttagataggaaatctgaagttatactgatgtgatataacaagctgaaaggttcagggccatgggtggtcaagttcaagtgcacttttaaacactatcattttacacacatgtacccagaaggaaagttctcttaccttttaaatgttggttttccattccattgtgtgacttattcaggtaagtatacaaagatgccaagtttacaattttctctcatgtcacaaacttattttttaaaaaatctgaactgtgatcttcccagttagaaatattcatttttaaatcctcacttttcaacccagttctcaagttcagatctcctcagggagatattttaacctactcatgtctggatcccaccccagagagttgatttgtggtggcaaggtgcagacagacatgtattaaaattacccgaggtatttctgacgggcagtcctgttacacagcactggtttaagcacacacagattctggatgggtcttcagaaccatttgctcttgtcacattccaccaggaaataaatacataaatcataagcatgccagcttctctgcatttgctgctgctacgataaaacatattccttattcttatgttccagtcaacgttccagacagtacagctaacggcagctgcagaaatcaacacctataaccctgagatatatgtgattgaagataacactgttacggtgagcatatcacacccttccctgtgagcctcagggtctgtgatggcattccacttctaaaagcctgggatagtcactcttcttacctacatgtatgtagaagtatcttactaaaactttaaagatctgatgtttattatgttgagattttggcgagggtgtgtgctacttaaaaagttcagtgatacacttgccttcctccatgccccccactcatgtcagcaaagctggctttcctagaggtggtgatccagtgagaagtacaacaaaaggggctctatgttctttgggactccatggtgtctcttctcatgactaagccagcagcaccagttcttcctttctcctcctgcttacacaaaatggtctggagcttaggccacaaaacttaatcatgcttatttaaatcataaattgtattttgaaaaatttttaaagaaaggtactgaagcatgcttaataaataatgcatttattagagggttttaaaaaatagttctccttacaactagacactgacactgtgtggcatgtccattcattagatcttacattcgggaggactataaatggtccccttgataaaaaaaaaaaaaaaagcttttacagagaaatgtactttcacagaaaacaaaggctctctgttctaagagctggcatgagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactcctctggcttggtcaaaaagttatggccccatgaactatgggcctcctcactccatgcctgagagtgaagctcacagcactggagccccactcttgtccaagggaaaatgattctacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattagattcctcttttattggtttcctctgagcaatactaataaataacagaagccaattactaggtgcaaaagtaattgtggtatttgccattaaaagtaaagaaaggctgggcacagtggctcaaacctataatcccagcactttgggaggccgaggcaggcgaatcacctgaggttgggagttcgagaccagcttggccaacatagtgaaaacctgtctctactaaaaatacaaaaattagctgggtgtggtggtgcacgcctggaatcccagctactcaggaggctgaggcaggagaatcgcttgaacctgcgaggcagaggttgcaatgagctgagattgtgccactgcactccagcctgtataacagagagagactctgtctcaaaaaaaaaaaaaaaaaaagtaaagagaaagtacttttaatggcaaagactgcaattacttttgcaccagcttaatattactcagttgtgtctatgaaaaattttttaatctaaacaataatttggataaatttttgaataaggtatgtaacctaaataataacttcacatgttcctaagtatctgttaatttatttgaatgcctggcccacttaaaaatctgatccacaaaatgctatagtcatgggtccatagggatccgtggttccctgggttagaaagctgtggaaaagagagaagtaggcttatgactgccattaagcagtgagctacaagaatttatcatcactttattcataaattgataaagccttacattttagctcttgaagatacaaatgaaaggaaatacagtcaccaaggccagttgcaagtttagcccagcccataaatttatgacaaaaagcagctcatctgccattgcaatttaatgttacatcaagtaaataaaacacatattatcctcttcttttgcttctaaatacagctctttaggaatattttctaaagagaatgcttgagacactttccccaattaattaaatttcccctaattaattaaaaactgaatatacagttttactgttaacactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgaggtttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagttatatattttactatttttatcttatacattcactttgctcacatccaagactcaatttaagaagactgaggctataattaatttgccataagtgtccagtctatgtttctagcagtgaccacaaggatcttcttttgtaagactcttaaactgccttcgaagttttgagacagtgtaaagcattgctcctcaaagtgtggcccagggacagatggtgctgcatcacctggagcctgttaaaaaacacagatctcaggggccactcaaaactattcaagtcaaattgtaagttctacagcatccccaggtgattcatattgcattgaagttgagaagcactgctctaaagcttaccttttgaaataaaatgtgtgcttggaatagagagggaaaaaaaatcagccaaactgctgcaacatgcaaaagcagagtcatctgcacagtttaaaaaaaatcataataagcaggaaggtttaaatatttttaaagagtaaatatgctgaaataaatatgctgtaagttataaagtaagtacacgttgggctcacagactgccatcgctgtacagatggcagagtaatgcaaagacagggtggaaagtgtgtgtgtgctgccataaatagcgatgcaccagcatctccattcatgtctgcggcgctctctcacatgcctccctgcccatcgcagttgtgctgagccgtctcaggagggcagctcactgcagcacaaccatcaataagtgtgtctgctatatatctcacattaaaatacaatcttggagagctgaatgtgggaattgcagctacttgggaggctgaggcagggaggatcctttgaacccaggagttcaaggccggcaacatgagaccccccccctcccagctcttaaaaaataaaatgttagagaaagagagcactaagttttatttctttgtttttcacagagcaggttaggaaatgctgtacaggttaggaagacctgtattaaagcaatcatttatatcccatagttaactggaaaataattttatacttactttttaaaaagtacttctttttatttattctacatcacttgttaaaaactacaaattgcattttcaaaaactccttcctgatcctatcataatcttttaatatttttaaggtgtcaattaaagattggacatcatcttacataaaatcagggcctaattttcatttcggaaccactacagcctgactttaaagaaaatggctactaaactgaacttttggttctatgcaaaattaaatctaagtaagactcaagttgctaagagcaactttactataacttttactatggctctggctctactgccctctgctggatgatccaccgaactacatcacacaaatcattcttgagagatcttcactgtaccaggtgctcagtaactgtgtaagatgtctaaatcacttatttctcaaaaaaggctgaaaatatattgtgactctatacatcatatccaaaggacaaaaatgtccacaaaataagtcactcattgaatatctgctgttactttcattcaaagatgataaaaatcaatttcattttaccacctgttcaaaaatacttgaaacataaataatttgaatttcctatttcttaagtgaacttacctagcaatcatgcaaagtcacggctttaaagtgaccaagaaacactgcaggcaatctgattaaaggctaattattttttttagattactcttctagttacttgaagctaagttacagagatgatagaaaagctacatatcagagtgacagtagccccttaatatctgaaccaccaattaactctgccactcctaagtaagcaagggtcagtaaagatcctatctaagtcaagtgcaatgcactaaaatctttcaaggccattccatcccagttctggcatgccccaggttaactccttaacctctctgttggagactttaaaagcataacagtctcagttccaaacttagaataaagcctacttaatgaaggcatgattcttttaaaacataaagaatgttctatgttctttaaaaacatcattaccctcaataaggaacttctaaagaaatatctaagtaggaaagtcttgaaatccacatatacctatcaacattgcatatgacataacatccatttaacaacctatgtccaaaatcctagaaatgtccagtgacccagtaaccccatgataatgtgcttttagatataatgcaacagccaacacccaccccttctctccaatggggacaggcggaagctcgatggcaagccagagtgacactgaactgtgaaggtaaggctgagaccaaacaggcaacccgaacccggcagaggaagtaggcggagggtttgtctgcccttccagtatccttctggcccaatctctccagacggactaatgaacaagcatcaactgatgtaaccaggtgattcctaaagtcagtgtggctgtcctatgggtcccagccacagataagatgcagagtgttcctcaaggtattttaggttggcagaaaaagatcactgggtgggtgcctggcacaaaacaggcattcaataaatatttgttgaataaatgggttccttaggtaaaagatgttttcactacatataacaaataggattactacgtttcttatttgtcccagacataagaaaaaaatccttcaatctaagtgtctgaaagtatagcttttgttcttaatatgcataatgcaaattttgtgatgatgccgactgcccaaattttgcctgtattttattattttatgagctatgtgtttacctgaaatttgctgagagtagaccttaaatattctcaccacacagaagaggggactatgtgagctgaggaatatgttaattagttggattatggtaatcacctcacaatgtatatgtgtatcaaaaatcacattgtatactttaaatacatacaatttttgtcaagtatacctaaataaagctggaaaaaaaaatttaagaactatatgggacttatatgtacaagtctatcaaaatactataaagcttaaccagttaaaaattggggcattgtttacctaaacatttcaacacaaaccaccttgttgctagttagctttatgacaattttgtgctgatttgtatattgatacaaaattaacaactaataaaaaacaacaaaaagttttctggtaagattatagattctgaaatcccagaaatctccataatgagaactattttaggcaatttaaaaaaaaagaaaatactctttttaaacttttgaaatcatgggttttagtttattatttttaatatatttctgaaaatgtataatatcaagactgtctgataatgcttttttaatactttccagttctgccaacattcctgtcatgcatccttaataacaatgctctcccagaaccgggatggggggcggtgaggtggggttggtgggggagtacgtttctgagctagttaaagtcactgaggagggcccatacctcaatgtgtgttgagttacaattagaaattagtcatggaaggacatgtctaccacagatatctttcctcacatttaaattattccatttcttcctacagtcctccttctatctttagttccattttaaataacccttcatcctacatacccatttatcttgcttcctttttctcccttttgtcccactagtataagagattgtgcttcagtaaactatcctgatgtggagagaaaaaaatcaaaatgtgatcaataataatagtttaacaaagttaagattgcatgctctaaaaacataagtgattaactgttggatgcccaaaagcactctttgtttcctttccaagttgatgactcttcgtatatttcctaaaaaacaaaatcataacaggtattaaaaatagaccattctactatacgaatataaaatatatttgaataaatcagacaaatgaatatcacatctatttcaatggctcctcttttaacaatcatgacgagagacatcatgggcaaggttacataggggaagacagaaagtctttagttttaaacatttttttttctttccaaacatacctactacttcaacatttctaaatatgcttttccaaaggcagatatcttcattagctgttgaattaagtggtcacctctcagaagttcctaaacaagtttgagctgccctctggtatgagctgttctttgacatatgcactctacctacctgccacccttccctatatcacagatgatctcaaagcacaggccgagactagaaccagactagaagttacatagtttgtggaaaggaggggtaaggagaacatatcactttctcttctcactctctagtcacattccatttctgtagggagaggaattcaaattcaactgtcctctgaactcctgcacttcctcggactctctatggacaaacaaaagcaaaatacgaagcccaactagtcctcaaagcatgaaaacaagaatatgccccaactcctgctcattacctgtatttctggggttgctcccatctactttctgtccactgactgtgcaccctttcctccctggtgaagaaagctacccctgccttccaggcttgcagctgatcttagaatgctcttcctacctctcgctctctgggggcctgcctcctgttgtgtcagccttgttcacagcaagggaacaatatatctgagcttcactaagtttcctttcacacatattctatcctctaatccctacgtattctaacaatgggcttcaattttattctgaaaacatggtcatcaaatttcccaggccctggttatgagtccaacttgcttatttctaccactgactgaggcaggtcccctgggaaggaggggagaagtgccctttaaaagccctggctctctgctctggtcttttcatctactgagctgttcattaactcctcagctttctgtcaaccacaacgctgtaggcaattctagacaattctagacattgaatgtgcaaccacagaacaatcccactgttaatgttactacaccaggggagaaactagggagttgggccttttcatcccatcagaatgctctatttaaccagagaattacttgcccttattgacagaaaacatgccagaagttcctatttctgtttttaaatccactcactgcattttctcagagggagcaatatctcaccatttttttttcttccctaaaaaggacctctaggaaaagcctctttcactttaaagaatttctattttagccattacctaaatagctaatgcattattctcactctccaacagaaagaccctctaattcaagggaattataatccaaggaaaataacttcatgtatgaacccctccaacagtccagactaggaattctcactgttatcactcattgaggcttactgtgtgccatgcattctttggggcacatatttttcatgcttaacaaatcttggaaagaagatatttcacagataaagaaaacaagatactacagtcagtaaaaagtccataaatatggggggatttatctaaaaattcctgagaaaaatcaggtccacatgctaaaatgtgttattttcttaacttacctttttccatatgggcaccttggcttttaaagtatcaatggcatagctcacagcttcaagagatgcagctctgtgggctgaggacacagcaatgattatgcttgcttctgacactggaaccaagctttaacaagatgaagagaaaaaaaaatcaccatcatctctgaatctacgtgttaaagaatctgctagacagatgaaaaaaaatccaggtatgcagtcttagaattatactgtagttctattttacgtaaacatacagttagaaaagagtaattaattgcagtagcattcagcagaggcagtagatgaggctgatgctacagctaatttgttagaatctatccactaaaccctcctgatgggcaccaaggaaaatcctttcattgatagagcaaacatctgactcaacaaggcacagtgccaagtaatgcctagaaatacaaagttatgtcctaacgagtataatacaaaatttaaaataatacatatcaagtaataggagtgataataaccattaataaaactactggttattaataacaaactagtaactaacagagtatgatagatacagtctcaattactggcttctttttaaagccaagaactcttctctttttaggggtacaaaaaggcaaaccactctaatgactttcgaggcatttatatcaaaaagaatctgtcacagattgtcatagggcctgcaagtcttggcacaactgcagtttgttacagcaacagaggcaacaagagctctcccaatatcaaaactcactaggcagtccctaaaggtactaacagccatccctattgtcctccaaaaataatacatgaatattcctctcatggtaatatagaattactaagaaagattcaagaatcagagttagtacaaagatggaaaacaattacacttaacttttagagtgataaaggaaatcatacccaagtctatggaacactgctatgtgtttgactggccatttctgcctaatgtcactacaaatctttctgacttcattttccgccatgggtagatatgcttcatattctaagctaatgacttttttcccttcaaagttatttcttgtagtccctttaaaaatgaaaaaaaagaaaaagaaaacaattaaaataaggtttttccctacaaaagaaatagcacgttaataaaaaaggaatatttttaatagtaaattaatagtaaacaagcagcataccaattcttctaaaactactttgaaatcttctaaaaacaaaatttgattaggaaaataaaacagatcttcacaaagatgagcactgattaagcaagcttactaaaaacactcacctggcaaaccgggcaatattcctcttctgactaatagatacttaaaaggaaaatatttatgttcccaggactatcaagtacatttttaccttcaattttggaaaatctagaattctctctcctaacaatgacttttatcctacttttcaaaatgccttgtaatttaatataggttaatttgaaggttactaaaacaaaacaagaactaaaaaaaagtctacccaccatcatcggtaatcttggtttaaagttcagtatttcaaactcctccgttaacactgaacatggaaagcacatgctaatttctattgtcttatacagtgatagatgcaatgaaaattacaactcacctacaaatagggatattgcaccacagagcggagaaatcaccaactgtgagacttcatctactgaaagtttctcggcagtaaagtttataacatctttagatttctcttcaacttcatccatatctttcctagaaataatacattaacaaaccttaacagaagtcctaggggtaaaacactcaacaacttataggctctttcaatttatatttttttctacattatgtcgatgtaaaaggaagaggctgtggcacaaaatatagt

SEQ ID NO: 1111 - DNA, 100856 bp, Homo sapiens
attgtaaaaaatgttttatgcatctctaattgttttacatgctttaccttagtaattttttaaaatctaattttaaaaagtgtaacaaaaaacactacttgccagacgtatctacatgaatgtcacaccaatacctcagacttatctctagaacccagcgagcactatctaaacacactctccatctcccccaacaccatgcacccctccaccccaccctgttcttccccattccaactcttccatctggttgctttatgttttgtttttcatgatattaccagtgtctctgtcaccaggtctaaaaatgccggtcatattttacttccttttagtaccaacaccacacaatacacatcaggttttttccccaatgccttacgagttctttcattttccctgccctgctctttatgtaagtttgggtcttgaaactgcctttatgcctacaccatttatcagcaaccaactgtcttttgtctcctcattgtatatgatatttaatttgactacattatattatctaaggtatatcatatcttcctttgtaaattataaactgagattaggactcactttttatacagtttcatatctgccaaaggacttagcgtattgttttgcatgtaataattaatgaacataaacctatacatttccagcttatgacattaatgatgtaaaaagccaaaatcatgtaaaggccatttaaaaaatacagagcacctgctacttgccaggtagcatataaagtgctagagatatggtggtaaacaacaggagcaaaacaaaggatgttttctactctcaaattctagtgagaaagatataatgaaaaaatatatgattataaattaaagagttctggagataatgaacaggattgtctggcagataatattatagtgacctattttaaattggatgggcagaaagtcctctgtgaggacatctttaagctgagatggaagaaagagaaagaggaattatgtgaaaagtcagaggctatgtgtccgagaagaggtaataatatggtaaagaccttgaggataaaagaaaccttgatgcacttaaggaaattaagaaaggccaatatgacaaaagccaagtgatccagggggagtgaccaatgctaaggctggtgctgtagtcagaagccagatcatagggtccttttaggccacgttgagtgtggtttgtactacaagaaagcgatggaaaactatttaaaggatttaagcaaaggagtagttgcctgattcatttagaatcttgaaagttcactttagcttctgtgcagaaatttgatgaggtgggggaatgacaaagggagaccacgtagcagattcttaaatagcccagatgaaattatcttgtgaaatggtagtagctgtgcaaaagaagattcacataagatgggcttgagatatattttagaggtcaaattgataggaccttgtgactgatggattctttgtttaagttagagggaggtattactttccaaatttctggcttgaacaactggtcagatagagtgcccagttgttttgaaaagaaagagattgggtggaagaatagtttagatgagaagtcagggaaccagaactcagtgttaggtatgttacgcgcacaatgcccactatacatccaagtggagatgtctggtaggcagtagaacaaatgaacccggaactctgaagaaaggtcaaggctggagacataaactggagactcatgatatttgtttatttatttcatgtcaaacaattgagggtatatttaaataactcatgaaatagctgattgattaacagatattgcaacatgtatataaaaaaatcaaacttttttttattattatactttacgttctagggtacatatgcacaacatgcaggtttgttacatatgtacacatgtaccatgttggtgtgctgcatccattaactcatcatttacattaggtatatctcctaatgctccttcccacctccctgcaccccatgacaggccccggtgtgtgatgctcccctctctgtgtccaagtgttctcattgttcaattcccacctatgagtaggaacatgtggtgtttggttttttgtccttgtgatagtttgctgagaatgatgatttccagcttcatccatgtccctataaaggacatgaactcatccttttttatggctgcatagtattccgtggtgtatatgtgccacatttttttaatccagtctatcactgatggacatttgggttggttccaagtctttgctattgtgaatagtgccgcaataaacatacgtgtgcatgtgtctttatagcagcatgatttatagtcctttgggcatatacccagtaatgggatggctgggtcaaatggtatttctagttctagatccttgaggaattgccacactgtcttccacaatggttgaaccagtttacagtcccaccaacagtgtaaaagtgttcctatttctccacatcctctccagcacctgttgtttcctgactttttaatgattgccattctaattggtgtgagatggtatctcattgtggtgttgatttgcatttctttaatggccagtgatgatgagcattttttcatctgtcttttggctgcatagatgtcttcttttgagaagtgtctgttcatatcctttgcccacttgttgatggggttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttatcaattttggcttttgttgccattgcttttggtgttttagaaatgaagtccttgcccatgcctatgtcctgaatggtattgcctaggttttcttctagggtttttatggttttaggtctaacatgtaagtctttaatgcatcttgaattaatttttgtataaggtgtaaggaagggatccagttttagctttctacatatggccagccagttttcccagcaccatttattaaataggaaatcctttccccatttcttgtttttgtcaggtttgccaaagatcagatggttgtagatgtgtggtattatttctgagggctctgttctgttccattggtctatatctctgttttggtaccagtaccgtgctgttttggttactgtaaccttgtagtatagtttgaagtgaggtagcatgatgcctccggctttgttcttttggcttaggattgacttggcaatgcaggctcttttttggttccatatgaactttaaagtagttttttccaattctgtgaagaaagtccttggtagcttgatgagcatggcattggatctataaattaccttgggcagtatggccattttcacggtatcggttcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagatattgggctgagacaatggggttttctagatatacaatcatgtcgtctgcaaacagggacaatttgacttcctcttttcctaattgaataccctttatttctttcttctgcctgattgccctggccagaactttcaacactatgttgaataggagtggtgagagagggcatccctgtcttgtgctagttttcaaagggaatgcttccaatttttgcccattcaggatgatattggctgtgggtttgtcataaatagctcttattattttgagatacgtcccatcaatacctaatttattgagagtttttagcatgaagggctgctgaattttgtcaaagaccttttctgcatctattgagataatcatgtggtttttgtctttggttgtgtttatatgctggattacatttattgatttgcgtatgttgaaccagccttgcatcccagggatgaagtccacttgatcatggtggataagctttttgatgtgctgctggattcggttttccagtattttactgaggatttttgcattgatgttcatcagggatattggtctaaaattctctttttttgttgtgtctctctcagcctttggtatcaggatgatgctggcctcataaaatgagttagggaggattccctctttttctattgattggaatggtttcagaaggaatggtaccagctcctccttgtacctctggtagaattcggctgtgaatccgtctggtcctggactttttttggttggtaggctattaattattgcctcaatttcagagcctgttattgatctattcagggattcaacttcttcctggtttagcattgggagggtgtatgtgtccaggaatttatccatttcttctagattttctagtttatttgcgtagaggtgtttatagtattctcttcaaactttatttttaattgatacttttttttacctgctgagtaaaagaacgttatgcaaaagcaaaacaaggattcctcaaggattttaaagccaattattgggtgtgtagaatatagtaagataatataatttaaattgtaccttctacgtactctttcttttgtactcttctatgaggatgtttaacacaaaaaaaaaagacagtcacggataattttagaggattgtttcttcaagtattttaattgtatcccccactgaccatccaatacagttatttgatattagttgtgaatatcttttttccttttttaactttgttttattatggtacaatatacatataaaatgtatcatctttaccattttaagtgtaaagtccactggcaataactacatttatatatatatttttccctttatcgccctccacctaccgtttcctctcctatagtaactaccattctactctctatgttcatgagatttgctttttaagctcccacatatgagtgagggcatgcaatatttgtctttctgtgcttggcttagttcacttaacataattgcctccaggtccatccatgttgctgcaaatgacaggattttaatttttttatggttgaattatattccattatgtatgtatgtttctttatccattcactcattgatgggcacttaggttgattccatattttagctattgtgaatagtgctgcaataaacatgggagtgtagatatttcttcaatgtattgatttcctttctttaggatatatacccacaagaattgccagatcatatcatcgttctagttttacttttttgaggaacctctattctgttcttcatagtggctgtaataacttacatttctagcagcactgtatgagggttcccctttgaccccattttgtcaccggcaactgtttttgccttttttatataagccattttaactggagtgaggtgatatctcattgtggttttgatattcatttttctaatgattagtgatgttgtacatgttttcttatacccgtttgccatttgtatatcttcttttgagaaatatctgtcgagatcttttgccaattttgaaattacattctttgttaggttttagttttgttgctattgagttgtttgagctccttatatattctggttattaatccctcatcagatagtgtgccaatgttttctctcattatgtgggttctctctacatttagttgatgttttctttgctgtgcagaagctttttagcttgatgtaatctcatttgtctatttttgttcaggttgcctgtgctttttaggtcttacacaaaaaaatctttgcccagaccaatatcttagagcatttccccaatgttttcttttagtaatttcataatttcaggtctataattcattttgatttggttttggtgtattggttatttcaatagatgctgagatagcatttgataaaattcaacattcctttatgataaaaattctcaccaaaatggatatagaaggaacatacttcaaaataatgaaggccatatatgacaaacctacagtcaacatcatactgaacacagaaaaaatgaaggcctttcctccaaggactgaaacagacaaggataccccctcttaccactgttattctacatagtgcagaaagtcctggccagagctatcaggcaagaggaagaaaggaagggtatccaaactggaaaggaagaagtggtgagaaagttttaattttatttttttgcatgtagttattaagttttcctagcaccatttattaaagagactgtttttttccattgtatgttctttacagctttgtcacagattagttggttgtaagtgcatggatttatatgtggattctctattctgctccattggtctatgtgtctgtttctatgccaatactgtgctgttttggttactatagctttgtagtaaattttgaagttaggtagtgtgatgcctccagctttgttctttttgctcaggattgctttggctattcagggtcttttgtggtttcttataaattttaggaatttttctgtttcgtgaagaatgtcatttgtattttgataggaattgcattgaatctgtaaattgctttaggtagtattgtaattttaacaatattagttcttccagtctatcacggagtatatttctgggtttttgtgtcctcttcgatttcttttatcagagttttatttatagtttttccttgcatagatattttacttttttagttaaattgattcctaggtattgtacatttttgtagctattgtaaaaggaactgctttcttgatttttattcagattgttcactgttgtcatataaatgctattgatttttgtatgttgattttgcatcctgcaactttactgaatcagatctaacagcttttaggtggactctttagatttttctaggtataagatcatgtagtctgcaaacaaacctaatttgacttcttcctttccaatttggatacccttcctttcttcctcttgcctgatagctctggccaggactttctgtactacgtagaataacagtggtgagagggggtatccttgtctgtttcagcccttggaggaaaggccttcattttttctgtgttcagtatgatgttgactgtaggtttgtcatatatggccttcattattttgaagtatgttccttctatatccattttggtgagaatttttatcataaaggaatgttgaattttatcaaatgctatctcagcatctattgaaataagtataccgtttctgtttttgattctgttaatgacttatatttagatggtatttaaagacataggaaatgggttagatctcctaaagagggaagatggaaagagaatgaaagagtttccagaatatagccctgggggtttcccgcacttatggcggagggaagggagccatcagaggaaactcagagtggccagatagaaaggcaggaaaaagcttaataaggtggtatcatgagaagagagtcttcctagaaggagaaatgcttactcttgataaaaactgaaaaatagggtgagtccacattagaattctcgctactggggaggactttctacacaaggttagagatcacttgtattttgtctactataattttagtgcataatgcatttttttggcatatagtgggcacttatatacatattaatctgatgacatttaataattgagtgcccaaatatttatgtcgagttgagagctagggataggcatgagtctttcttaaacatccttctcttctccttcctccaccccctcacttgccttcagaagcattgatcagagagatagcagtatcttcagttttttttaaagcaacatgaaacacactttattcctgctaacattaggaaaagcgagctgttttccaagccctggaggaaggaaattcagctaactaacgtgaggtaatgtagggtggctatttcttgaaaggtagtgaatcataactataaccatactatggaaaaaagtcctgccttaccaaccactccactgactgcttgtcaccaaaactacgctatgaaacgaattgtgttgagtggctttcattgtaaaagattttggtgaagggagggaaagaaactggtaggggttcagatcagaagatctggctttgccagtttctggagggtgtcagaatggcttcaacatacctacttccttggcctcaactggaggttttgtagctgtaaacaagaaggattgcatagttcagaataacgacactgtaagctcattgtggaactgggttaaaatcagcatgtagatctactaagaaagaaacacactcagcactactacagaaagaaacagccatgggccctgattgttagctttctggaagccatttcatttttacaatagatttatcacacactgtattgactttttccagtatagagtaagagaaagttaatattcctcatgttttgtctgttgacagactgaaaataattgcattgagtttggctagaatatcctgtcattccataaacatctcaaactccacatggctaaaacttaacccatccatgcccccatctgcatgcacacatacatgcatataacttcatttctcagtgtttttttctccatgaatggtagcaccattctctttcaagaaagagaaatacttccccttgggattatcctatctctacttattgctgcaggggcttccaaaattaggttttctgtgttcagtcttgcattcacacttctgaaacccagagctgaccgagacaaattcttcaacttcctgtcagtcccaacatagatttaaaattcctaacctggctcatgaggttcaccatgtattcctgcttccctaagtcagcctcatatcacaccaacctgtgtgtggagtggctaaatactctagccaggcaagctctctcagttcttctacctggctcctctggagccctccttattgctcatcccattcttagcctgattcaagattcctggtccttcaaatctctctttaagtgtccttacctggatctttctctagttagtacaaatttttctatctaccattggagcgaacattttttgaaactttgtatcagtcctgccttactcttggtggaatcctgtggtcctagtcaagtgcctgctccatgaatgtgctgaataaatgaataagcattttaattgtgtatctgtcattagtgtcagatgtgttatttattccagcatggttttagcacacagacacactctttgatgcagacttttcttttctttttacatatagcaacaataaaaaactagactttcatctcctgaaaatatcagtctaataatcacctatggctgtctctctggttgctgaaggaaaaaaaaaaaaaaggcagggcacacctggattgcattagaatgagactcactacccagttcaggtgtgttgcgttgtgggtctccggcacatttcagaggctcattaggaccctgaccccacactggggtttacacccctaaaagcaggtgtgtcccgtggcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtggaccccaccatagggcaagtcctggaaagattcacgttgcctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctcagatttgtgacaagttgaaaaatgtgtactgatagaggggagaagtttcatgtttcaaagccaaagacaagtttgttgcacacaggcaagtggggaaagaggaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgaatggtttaatatgttgtctgctgagctgatgggtcatctgtaaacggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctataaaagtctacgagttgtctgtagcatgtagaataagccctagcctcttgttaagcatcctcaataccagaaatcacagtaggaatgcataaaacattcacagacccatacattttggaatgattttgcaaagcataattttcattgcatgagagagttgtgggtgaagaattagggagtggagccgacaactttggtctgccagaggatcttggcaaggtctcaggagggagcaattttatttctgttgtcctgtcatagtttcctgatccatgacattataactactgatatttagtgcctacttcctgtctggatggacactgaatctatttctggatgtctgtgtttaactggataaatcatgacataatactgtattaaatttaagataatgcctgtcaatggaaggaaaaaattgtttgggcatgtgtagcatgggagttgactgttctcagagaaatgtaaacatagtagatatgtcatagatatgaattaaatgaagatcttttggatggatgaatgaataaaagtggagtgaaaatttatcaacctgactgatgagtaagataattgattagaaatgatgagccaaactgatttttaactttcaaaattttggccaatctacaaggtatttactgggatgaaaggaaaaaaggcaagattcctagtcagtcaatgagttaaaacattaatagtgatagtaatgccttgagtatttgccgaagagttgactgaagttatttctcatgtaacattctaaagaatacagatatcttttattcctcatgtaaagaaactgcctctctattcagaataaattcagtggtagcttgaagctataaaatagggattgaggctacagtctagaaataaaacactaaaaacaatacattggtaataaagataatttaggattcttaggtttgtgggctatgcactattttgtatgaagaagtttcaagagtgtgtgtaaatatatataagccatcttctgtagaagagtgtgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacacataatacattcaaaaaatagtggttcttctttattgtttacttaaatctattatctgtatgttatctgtaacaagcaggctgaggttaatagggacaattgataaactgaaccaaaagtttaaaaattaaaaggtaatacattaaaaggtagaagttgaaatgaaacacaatgagaaatttttgttggctgaagaaaaaaatgttataatgattaaagatcgatctgtgattgccatgtcagtaaggtatcttctttcctttggaatagctttacttgctatcaagaacctgaaggtgtagggtcttcaaatggtgcccatctcccacacaattaaaaatatccacatggactagtctttgagtctctgtagaatttcagatcagtggttgattcagatagactcctcccctcaaaagagaaggtccatatctcgcctaccctaccctctgtggacaaggtgtcccatatggtatattcatgccataagcagaagtgagcctgcctgtttatctagaatgcccagggtgagagacgttaggcatgagataccccttttagtcaagcaagttgactgcagagccagcaccaagagagttgcctggatagtaccgcaaggtgcttttcttcctgcatatatattgttggcctccttttacctccctgactccccaagagacatctcttctctcacttcttttgtaccagaggaaagtggtctctctgccaggagggtctgggcccagacttgctcgtgaagactatatctgaggagacccaggtgatttctacatgtccactttccacccgggcactctgcatcatcaggcttgtttaaaggaaactttaatcacagctggttcctaaattaaggtgtcacaaataatgactcaattaatatagttaagcatagtccatccatggactatcaatattcaaatagaacataataaaacatagaaatgattatcaaattacactaaaaagatggtctttatttggttattcaaatatgtttccagatctttcattactttggagttaccactgaaagcattatacacacactaactctcatttgggtaatagtctaaagttatacaattacactatccagtatagtatccactaaccacaggtggctttgaacacataaaatgtggctagtcagcgatgagagggctgtaatgtaaattacatactggcttttgaatacttagtataagaaaactcattaatttttatgatatatattgaaacaaacactttaaaattattgattacataatattttggatttattaggcgaaataaaattttaggttaaataaaattaattttatttttacttttttcatgtggctattataaaatttaaaatttccaatgggcttgtattatatttctattggacagcactgctgtagagaaacattaagttctctgtgtaaaaataacgctatctctttaggagatgctttcctgatatttatgcataaatgagtagaactttcactttcttttctagactaagtgttctatagttactgggccttcaagctgcctgcctgtccctctcttacaggaaagacccatctcaagttagtcaccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcatccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggctttctaaatgcactttagtttttgccttaagtttacttggtcactgagtgatatacccaatgacttgaaaatatatccccttggcaacagttctagggtcagatgctgaaatccgttgcacatgtgggtaatttatccattcagttgttcattgagggatgcctaagggcctgaacctgggcatacaaaagaaacatactccttgtcccaaaggctttaaagtttataagataggttattataggaaagtatggtgagatttaatctaggtaagacaataaagtgatgcattcctgaagaattggtgttcaagtgggggaactgaaaaataatcagaagttagccagaggaagaggctatggaaaagtttgccagaaagagcaaactgtgtgtataaagaccctgaagtctttgagagcacgatgcttttgaagaactaaaaattgtgtacagttgcactatggagtgtgagctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtggagaagaacatggagattctgaaggtatttaggagatagcacttggtaattattgaatgaaagagatgagtgagaatgttccaaagatgttactgaagtttctaatttgggctgtgacatggatgatgatccaatatactgaaaaagggaagagcagcaggttttctggcaaaatgatgagtttcgttggcttgagattcctgtgagacatagaagtaaaaatctagtgatcagttctatgatcagttccatgtatgggtgtggtagacagtagagaggtctgtactagcaaatcagaggtgagtaattgacgtaaccccattcacctccaaggctttgattaccatctctctggggtaaatagatcaaatggccaatggcaaatttctaaggattcctacagttcgagaagtgattagaatagtgctgctcaagtctggctgtaacttaaattctcatgcagagcttttaacagttctggtggcccatctcaaactactagaatctctggggtaagtctatagggcaccagtagtttccagaggtccccagatgattccagtattcatccatgcttgagaaccgctggagaagaaaagaggctgaaaaaaaggctaagagggtgaagccaaagaggtagcaagaaaaatcaggtcaatctgacattaacctgattaaaggaagagagtgttttgagaagaggtgagtagttggcagtagtaaaggttgccaagacatcaaccagggtggtaaattatgaggtctcattagatttagagaattagttcattagtaacctcggtaagacaagctttaatggtgaatccactgcagagggttgagaagtgagaaacaatagcaagcgtcaataacttttaactgggttcttccttcattaatacattttattgattacttatgtattggaaatacacagttgaataaggcatggttaaagcccttgagtaactcagttgagatgatgggagagacaggtaaatggacaattaattatgagataatgtaataagcatgacaatagacaggtacatagtgatgagaagaaatgaatgggagaaggcttcctggaggagtgaaatctgagtagtggacccagttctgactggttttgaagagcacatgtaagggctcaataaatgtgaaataattttcatctttttcacatttgggcaaaatcccctgggatttgctgcacatttcagcctcattccaaagtgtctaggtccgccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcattttacctctgagaatttttaaaaatcatagaaaatcttttttatataaactatgtaaaacactataattcacaaaaatgttcagaaaatagattgtagacttagttctaaaaaccccttttatgggactccttgtgtgcagtggattagacatgttcttttgacattatgccctgtgtagaaaatgctggtcaatgtgcaccatctgtttgtgaatcccttcaaggtctacctcaccacaataccagtctgttttcttgcggaagttttctagaagtcattagactacaatcattttgtctgccagtcattgtcaatatcacattttatcctttaaactctgcccagagaaacgtcctttgatatctgtaactcctcatctcattctgatcctctattggccaggataatatgatacattcctcactggtttttctcatgtatttttaagccttcctatcttcctgacctcctttaattctttcattgctgtctttttttctttttctttttcaaccatcctaccctgtggattccaaaaccaagcatggaactttaatactgaccaccaagcatatttccctggagtattttctgtttacatttttgtattttcttgtttcaaagatagacaaagtggcatccacacattagtgattgtttttcaaatgaatttttaaatccaagagattaattgaaaaccatggaggttcagaattttctttccttattttctaatgttagaggtttaaatatgctcttttaataggttgtttcagaatagtataggtttattcaaaatgtccatagttgaaaataatggaaaagtactaacaactaattgtctggcagcatcagatggtggttgatagtgtgagttttaatcccttccttccccacttacaagtggtgtgaccttgggcaagtgcttagtcatcccttgtttcagattctgcatccataaaattgggatgataatagtattgtctacttcatagggatgttatgaaaagtgagttaatacatgtctttgcatgtattaaaactgtggtacgtagtaagcatgcaataagtattagtaattagagactaactttccctctttaaattatgcttacaaaatgtatcagctggggcacatttttcagctttagttattaaaaagacttgcgtacgttttctgtgggattttgaagaagtcctggcagagaccccaaacctaaaatcaaacccagaagtgacctagttgttagagttctgaggcctcatgatgactcaggatcagcccagatttataaaattgcaaccataaagcttggcactactctctggggacatttacctcttgaactctttctaaatagaatagaataagataaaaaaaaatagctgaaataactggctttttcaggactacaattatataaactgtttctcacataaattgagcatgattattggccattgtgagattttatttaggcaatatgaaaagatgacatttaaacacatttttttaaaaaaacatactttgagaatggtttccaactttgatgttttgctcttttgactcttattctccactagactagctggaggaaaagagttctagaagtttggtacttttatgtcctgtatcacctctaaaacccaaggatattttactttccatcacccaaaattatttttattgtagaattcataaacatcattatcttttagaaacattgccaccaggtttaactagatgtgtgaaaagagtacatagtttaatatagtcaattattatatgaattagtattaatggatttagtaagtattaggacttaaaaggaaaaactaaattaaggggccattttaattaaaaagctaaagactgctgatcaattcttgcagcattgtgagcgccctctgctggctcagttcaaagcaccataatgcacgtaccctgaggagcagaggcattgattatttattgaccacctactaggtgccaggcattcttgcatacacaagcataagttttctgtcatcctcatagccctgcaatggtaaattttgtcatgttctcatatttgaattgattttctcacttttaatatatttttcctaatctgaagttatgtgagtgaagggattatatactttaattattgcttttataaaaaatatcttgaatgaatgactctttataaaatatggaattggaacaagggtcattcatgttttaggattaagaaaaactttagagtggaacaatttgaaatgtatgggttttgtcttacaatggaatagagcttcagcttaaaaaaaaaagacagttggtggaaggtaagggcttttactgcttttctgaaacttcacatcacatcatgagttttgaaagatcaggtaagtatatatgttgtcttagtagccagaaagccagactgagagccccagtcaaatgtctgaattggtggggaagtgacagtacgatgacgcaggtagataaagcaggcatttacttgcattagaaagtcccaagctctcctagccaaaaagtatttcactagcactgtcaaaagttatatagaaagaagaccttagagtctgaccttttccctggtccttctttctttagtggaaatgccaaaatactgagaaccattctaaatggaggaaaagagcagggcaagatagggaacaagtaagtgacctttttcttgaacaagtgaaagtcgattgtacagtctgtgggcatatttgctatattttatatattttcagctaaaagcttcagaaagtggaatagatttcagttaattcatatgtctggaatatttctagagttctatgctatagagtgaaataacttagagatcaaagatgctattttttaattctaatctttccacttacggatttgggcaagttatttgattcctttaagactcaattttctcttctgtagggtaggattaataatacagcaatcctctgctactactgtgggtgtaaaatgagttaatgtgtatgattacagttccccaataatgatatgccacatatattttatgagccaggttatatgctgcattgcatgtgcagcttaatatgcttacattaatctttaatatgatgatgccaatggcaactaacatttgcatgttttcgctgccaggctgtcatccaagcacgtcacacatatctcatttactccacagtccttgcagaaaccctcggagataggcatcttctgaggaccccagctgattctgtcttaagtcatcccactcacaaatcatcctttgtaaagatcttcaaactcagagactgtttcctttcagaccatctgttactgtcttaaaattgaagaaaataatattttggaagagaagtaggggagaatcatagtaaagagaaaagacctctccaaagcttagatctctgagagtttggtgataattatgcagtagtacattctagtaaaggatttttttgtggtgatataatgtatttcaaaattccctccctcatacatactgagttcctgcctactgcatgtaaggcactatcttgagctgtgggaatgctgctgtcaacaaaagtcaatctgccctcatggaggtgacatacaaggtcaaatatctaatctcccatagtccctgtcacacttggagcaatgacactaaaactggtgatatgaataagaatgaaagggggaggagtaaagaatgtatttaactagctttgtagtatttctttgatcaaaattcctgttcatttgcatttatatacacatttatatatgctgatacacatcagtaggaagaaataaactgtagtaagcatgcatttttacattttctttcccaaattaaaaaaaataggaaagagaaaggcttaaaaggagatggtttttaatgtggctttgttttttaaatatctagtggaaaaatgcattcaactgtggaaagaattagtcattctagttgtttaaaagcagggaaaattatcaccatgttaatttctgctgacctcttttatgttaaaccatgtaaagtactttttcaattatggagctgatttgatttactaagagtttagatgagtaatttatgaactgaattgaaaaccagattataaatcacttcagcctgacatttggataaaatataatctgaggttgtttatggtgttctgtcagagaaattcatgagaattagctctcatggcagttctaataatcgtcatttttgaccaacttagaaatattgtatttctacccaaagacaatttgcttaacatttgatatttcaataggtaactaaacaaagggggaacaaaggatattacttttatttttaaaacagtaggtttttaaataatacaagaaaaggcataaccatctgttaatacatcaagcttgtccatgtggtccaggatggctttgaatgctgcccaacaccaatccgtaaacttagaatggcgatcattaaaaagtcaggaaacaacaggtgctggagagattgtggagaaataggaacacttttacactgttgatgggactgtaaactagttcaaccattgtggaagacagtgtggcgattcctcaaggatctagaactagaaaataccatttgacccagccatcccatgactgggtatatacccaaaggattataaatcatgctgctataaagacacattcacatgtatgtttattgcggcactattctcaatagcaaagacttggaaccaacccaaatgtccatcaatgtagactggattaagaaaatgtggcacatatacaccatgaaatactatgcagccataaaaaaggatgagttcatgtcctttgtagggacatggatgaaattggaaatcatcattctcagtaaactatcacaagaacaaaaaaccaaacaccgcatgttctcactcacaggtaggaattgaacaatgagaacacttggacacaggaaggggaacatcacacaccggggcctgtcgtggggtggggggatgggggagggatagcattaggagatatacctaatgtaaatgacgagttaatgggtacaggacaccaacatggcacatgtatacatatgtaacaaacctgcatgttgtgcacatgtaccctggaacttaaagtataataataaaaaaaaaagatataaatgttggcaagaatgtggaaaaatggggaacccttgcccactgttgatgggaaagtaagtataactataatggaaaatagtatggagattcctcaaaaatttaaaaatagaactattacaagactcagcaatctcactgaaggtatatatccaaagaaaataaaatcaatatgtcaaagaggaaaaaaaatatgagattttcttgcaattttttttttagctgatcagttatcattagtgtcagtgtactttacgtatggcccaaaacaattcttccagtatggcccagggaaaccaaatattggacacccctgagctacattgtagagctattgttcacaagcccaaccatatgctacaactacctggggggcttcaaaaaaattcttatgtctggttcttaacccagacatgtcaagtctgagcctctaagagtggggcccaagtggaggtactggtttcaaactcccttcagttgattctaacgtccagtcaaggctgagtactgagtggaaaaggagtggactcaggatcacacaggttaagggagaaaagctttggagaaggccatgatcacaagctgatcatgtagcagtcttacttcttctaccaagattccgcaggcacaacaaaagaaaagagaagctgggcatggtggtgggcacctatatccccagctacataggaggctgaagtgggaggattacaagagcccaggagtttgaggctgcagtgagctatgatcacgccaatgcactgcagcctagatgacagagtgagatcctatctccctaaaaaataaaaagagaaaaagtcccagaaattaagaaaaaacccagaacactaggggaaattacaggatgttctctgaacagattctaacctgtaaccagtacttgaaagttacctcaatattattgctgttgggggctgcctctatggtaaaaacagtgttaagaagtgaaaaggggaaacatatctaaatgtagtatatgtatttgctcacttattaagattggtttttcttctgtggaagaatgattgtttcatgactatttccatgaactttctttctggctatgcattcattctttttacacacattttgaattaagatatatgaaataagcagaagatgtttagtcaaaccataatagaagctttgaattgtttttcgtttactgacctttccatttcagcacccatttctgggctgtttgtcgggggtgggattatgacaaagatacagtcctgggcaagatgaatgaggtcactatttactaagccttggaaataggccagaaacattgtaaataaataaatgtagttaaccttaacaaaaatgaaaatacttattcctacaagatattaatcaatttcaccacaatttcctctgagtgatcgcatcctgtgtgtctaagaacccttgagtgctgatgttgagagtcatctttcagtatctaagagtggattaactaacaactgtataggagatatttgaaaattaatgaatcagaaattttatctatatattagaaggcaactattgtttggaaccacattgtaacagatatgagattacatctagtggcattttgacccccaccccaccaatttcccacttacacacctgccatatgtttttctatttggaatctcttctgctcacgggtgaatgaaccacatcactggcttcctgggaaagctcttcctacatttattcttaagtaaacatctctttcttgtggcttctggagggctaattgttctcctatttctaagaatcattatttttagcctagaacaagaagaagggaagggcatgagccacactggaaataaagtcccaggactttggtgagactacatgggacacatcttaaaatagcctaatgatttagtggcccttttcccagagagctgagaggcactcatgtggagagaaagaagtttcagggaagtgatgttagtaagtgagaaagtgagtagtttgtggtgtgtgtaaacctcagtgtgagcctgggcagtgatgacattgtgatgttacctgatggagctaaaactaaaacaagaaggaggcaatgcagaatattaaatagataagagttcataatgcaagagtttgtctagtcttcacttagaaatttacaaaacagttcagctaagaaaccgataacaatacactatttttgcacataattttttggccattttcattaagctatttacatggtacattgtggttctaaactattgtctttttaatcttctgggtggctctctctagaataatagatttgtttctaaatattggatgtaatcgtaatgaaagtgtctattatacacgccatattatttgtgacccccatcctctcctgtccttaattttcttcttgctcaattgtcttaactgagtgttgactataaattcataaaaattttagtattttcagagggaacttattaacatggctattgtagtaaataacaggaacttcatgtagactgaatctaccatttgttatctatttttgacagtaaacaattgattttagtgaaaactgaaaattgtattataatgaaaattaaaatgccttgtttgtcattctcttttaatttaaattttgttggtttggcattaggtagccacaataacaactccctattttagaccttacctatctcccacacacaattttttttctcctaccatcttccctctgttttccccttctcttttcgtgtcatttctctcttcatcccttcctttctcaagttaacacggagaccttatgtgtccacctggactgttctttaccaaggtttgggccacagcaagactcctttccaattctaatagcaaccattgccaatcaaccccagcattctttgtccagacctagtcttagtcctcctcccttcagtctagttctccaggaagccattaccagttagtgggggttgccatttattctatgtgtatgctgtcgagaaaaacattctctgcatttcacagtaacagtgttcctgaccatgagaaccacttagggcaggggtccccaatccctgggctgtggatgggtactggcccgtggcctggtaggaactgggctgcacagcaggaggtgagcagtggaccagtgagcattcccgcctgagctttgcctctgtcagatcagtggtggcattagattctcgtaggagtgcaaaccctattacgaactgcacagccgtgggatctaggttgtgctttccttagcagaatctaatgccagatgatctgaggtggaacagtttcattccaaaccttactactgcccatggaaaaaattgtcttcacgaaaccagtccttggtgccaaaaagattgggaaccactgacctagggtaatcagggcctcacctggatctgctggagcagaatctccagaggaggagctcaaacattttcttcacttcagttgtgattaaaggttttgtttttcctgaatgacattttagaaaacgaaagtataaacaaacatcttcccacactccttaaacaaaatctctcctacccaggagacttagtgcaaataatttcacttctcaaatattagccttaccaggcatagtggcttatgctggtaatcccagcactttaggaggtcaaagcaagaggatcacttgaggcaagagttcaagaccagtatgggtaacatagtgagacccccattggtaccaaaataaaaatattagtttgtatctctgtaagtgttctgagtttgcccaggaagctacatttaggggtcaacattataggaggagacaaagtgccaatgatatagagaatggtcaccataaattcatgaaaacttggtacctagtgactagtgttcaaaattaacaaaccgaagttccacatccttatccaatcaaattgatgctaatgtatttatctgccaggaattaagaacagatgcaatagaattgtcatatgccaactgaagagggtgaaaagaaagacagcaaaaagaatattaggatactgcatcttactcttccccaaagtaacttatttaaaattacttaacatgggattttaataggaacccagctataacacaaataattttttctaacaaaagaaaataatgatcactgtgaagaccacttcttatatagtatagaagtactatctagtacatgagcattttatttatgtttggctattcatgcatttgccaaagtatctattgaagttttttgtttactactgagataatctggtttccaaatcacttttatctctgttgaaaacatgagtcatattccaataaatgtaaacatagggcagtttcttataaacgcaaggcattattggtatgctaattgtatgttccactttctgcatgcttaatcatcaccttccagctccaataaattgtaccttaattgctgaggatgtattatagtctttctattcttaatatctcagtagaagaaacatttttaaaagtgctctgataatattgcttacgttgttagataaatggctaattcttttccaaacgttagacacagcagttatagttgcacaacctggtattagctttaagtggttttccccactcctagtcctgttagctatctcttatatgattgagtctatctttttatggtgctaccagtcagaggtcatttctacaaccaaagtcaccttgtattagagaataattagttggcacagagtaattcacatttatcctcacattgtgcactgaatataagatagagaagtagttaacagaaaaatactggggatgagtgcacagttttctcttcttttgtagaatgttttcaatacaactgataaaattattttcacatgctataggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaaggtaaggcatgattttgatacgaattagataaagataagtaagtgaataccttttagtgttttaaatttatgttcaagtttagatgttcagaggagagggagatcttctaagtaattatgttctttttaactactcaatttctttctttacccaattgcaatagcattatttttcataaatgcactttgtgctataaaaattctacaatttgaataactctgaaatctagctctttaactacccacttttgcatcaaatttactttcaatttggtataggtgagactagtacccagcaaatataggacatttaaattgtgaaattatattggaagtctgattaaaaagaaagactttaggtttccttttttacctttagcttccaggagtaattgggaagaataatcagtgtaagcaaatctttcattcgcactcactatctctttttctaatttacatgttttccttcaagcagcaagagattcgtgtcttgagtttgaaacatttttctcatggtaactctatgctataggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctgtatgtttgctgtcttctttttcctaatagttttcggtttatctttaaaatattttcatagtagagtttttagtttttctcggatatacatagccacatactacaaaaatctcaagatgccataaacctaacccatctacaattgtaaaatacaggatcaggtaagatatatttttttaaagggatgaaaactcctgaccagaaatggtcattataaatgacttaccaatttattgaagttttctgcttagcaaagccaaaaggaagctgtggttccaattcttattttcatagaagtttacttatatcattttttggaagaagcaaagctttgcccccttagaaagttccaaaagcattcattcatgggactttgtaataatagacctttatgtccatgcagatcttgattcagtctatatttcagttgggcaaaatctaagaaaggacactctcttcaattaatggtgttagcaatagcaaagacatggaatcaacctaaatgcacatcaatgttggattggataaagaaactgtgatacatacacactgtagaatactacacaggcataaaaaataacgagattatgtcctttgcagcaacttatatggagctggaggccaataacctaagcgaactaacacaggaacagaaaaccaaataccacatgttctcacttataagtgggagctaaacattgagtacatatggacacaagggacacaaagtaggcacaaacactagggcctacctggtggtagacggtgggagcagagagaggattgaaaaactacctatcaggtactatgcctattacctgcatggggaaataatctgtacatcaaacccctacaacacgcaatttatctatgcaacaaacttgcacatgaaccctgaacctgaaagtttttttttaaatgcctttgggaaaattggctatctgcgtgcaaaagaatgaaattgaacgcttatcttagcaaatataccaaagtcaactaaaatggattaaagacttaaacacgatacctgaaaccataaaatttctagtggaaaacataagagaaaagctacttgacattagtctaggcaatgagtttttggaaattacaccaaaagctcaaacaacaaaagcaaaaataaacaaatgagactatattagaaagctcctgcatagcaagggagataatcaacagagtgaagagacagtctgcagaatgggaaataatattcgcataagtcctatatatttaaaatgtataaggatctcaccaactcgatagcaaaaaaccaaataactgattaaaaattagtcaagagaccaaatggctttctttccaaagaaggcatcaaaatggccaataagtagatgaaaaggtgcttaacatcaccaatcatcaaggaaatgcaaattacaaaccactatgaaatatcacttcacacctattagaattgtcattatcaaaaaggcaagagataacaagtgttggcgaaggtgtgaagaaaagggaacccttgcacactgttggctggaatgtaaattggtacagccattatagaaaacagtagagaagttactcaaattaaaaataaaactaccatatggtccagcaatccctcttctgggtatatatccaaaggaaatgaaatcagtaccacataaagagatctgcgtttttatgttcattgcagcagcattcacaatagccaagttacagaaacaagcttagtgtccattgacagatgaatgaatggataaggaattgtgtgaggtgtatatatacacacatatatacataaacatatacaatggagtattattcagcctttaaaaaaggaaattctgacttttgtgacaacatggatgaccccgaaggacattattttaagtgaaataagctaggcccagaaagacaaatactgtatgatctcacctatctgtggaatctaaaaaagtcaaatacatagagaagaaggtgagcagagagagggttaggaataggaagatgttggtgaaagatgttggcatttgtgtaggatgaataagtctagagatctaatgtacagcatgaggactggagttaataattgtgcactggaaatttgccaagagagtagatttcactctaaatgcacaaaaaagatgaccgtgaggaggtatgtaaagtgtagtaactgtttcactatgtatacgcatatcaaacctgatgttgtacaccttagatatacacagtaaaaagaaagcatgggctcaaaatcacaaatcctacctctgtcttactcatttgacaaaaattttttgagtatatgctgtgtgtgcttcctatgaagaagcagagggagatatttttattgccatttcatagggatattttgaatactaatatggaagggatttgttatatcaaggttactggtttttatttttaaaaaatacaaactatagaccttaaaggacatttttgtaaggatttaagaaacaaattatggagattttatctttaagataaaattctgagttgttttaatatttcattttagattatgtgaaaaaatttggagaaaattttgcatcatgtcaagctggaatatccagtttttacacaaaggtaattgttcaaaaaatagctgctataaatgtttacatatagaatcttaattcttctcatggtttggaagactgatatgttttaaagtaaaaattgtgtaacatcttcatcatgtctcttaaacttgagtattacaacttaatttttgccactcaaaattccacatatatttcaataaaatatcaatatttaggtggctatactgcataagatgaatgaaaatctatactaaagaacatttctttcatcaacaatttaatgaaaatcaaaagtagctatggttaattgtcttgttaacttaggtattgaaaatatcaacccaagtatgttattttaaatttctagttgaggggcaaaggaagaatatcagtctatatttttcattaaattatgataattgggaaatttaagaatttaatatccccttaaatcagatagacaatattcccaagatttcttactctctttctaacattctaggatatgtatgaaagggcacagttgtactcaaccccaaatctctcagttttcttaaaaacacactgtgaattcaggaatgttttttgactccatgaagatcaggcactatatcaagtttggggttgacagtgtctgcacatattaacagttatattaaaatgcttacaaagaaaatgctttcttcagtttaagttgactttttttaagtttaggattgtttaggagtatagaaatatgctaaagatatttaattgctgaaagtgttcatactataccaggcaagggcatgctcattccaatcttctcctaaattttcctctgtataacaaaatatgccccacattccattggacttttttccctaagctaacattattagaaatgttttccctaagctaacattattagtcaggggttctttgcaaatagaagtaaattaagtctactttttattctttggcaacacatgattatctccataattagcactaatgaattacccacatacgattttctttaataggaaccacattgcctttctcccaaaagcttactctagcgttcagtacttgtcccttcaacttttgaaatccactgataaatgcattgaatgagagtttcagagtttcttctctgagatttcgcttttagaaatccattagccaacttctctggctttttttttttcctagtatgttttaacttcacagaatattcctacttcaggaattgattattataaaaatatgttctcttcactatcgtgtatctggaggaggtttggggtggtgagattaaagtttaaataataatagttttttttttcttacaggatttaattgtgatgggggccccaggatcatcttactggactggctctctttttgtctacaatataactacaaataaatacaaggcttttttagacaaacaaaatcaagtaaaatttggaagttatttaggtactataaaaattgacaaacttaaatgatctgtgccttacaaatactagtactgtaattataaataaggaaaatgtattttccaaagatctaaatggccagtataattacagtaataattaggcagttcagaaactgtctcttaaggataggatttatgaaacttcagtgaactcagtattttacatttacacatgtgactaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcataagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcagaaaatccagctttgtttaaactgtatgtgtgtcaaatgtgagcatcttacactcagaaataattataaaataagcactctttctttctattcaaacagaagaaatttcaagtagaagaatttgttacaattcaatgttttcttgtttatgatgaaaggatactttgaaatcgttcaagaaatataacttgttacgccttttatcacataaaatacgaacaattttttgtcatcgaaaagtcatcacaaagatttggtggcaaaaaaagttgaacttcagcaagatgtttatttaaagtttaaagttttcatttcccaattgagattttatatttaatatactctaaaatatgtctgttgtaatcctagaaactgattatactgcaccagatgtaaagatgctattttcaatttctaggactcggaaatacataccatatgactgcagttttgtaaaacatatcaaaattgcataaaacataatgaatgaccaattttgagtatctctatgctaaatattcttaactgcttaatgtagtgattttgaattcggtatcatttaattttatgatctattttacccatattaccatatgatgtactttacccaggactctcatactttctcccttttcttaaaggatattcagtcggagctggtcattttcggagccagcatactaccgaagtagtcggaggagctcctcaacatgagcagattggtaaggtaagaattacatttttatatttatttcttcacaaaggttcaaatatattgcatgaataagatattaaaggagaaactgtgaatgttgtaaggaaagaaagattagaaatgatgaacagattattacatttagtggaattggtgaaagatgttatggttttagaagaaatttagcaaaaaactttctgaaaaattacaaaagtcaaacgagacattgttttaagaaaattataagatagaactatctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaacccttttgtgtcactctcaacaggatttatttttatatttgagcaattaactgcaagttgtaaaaattcatgttttgatcaaacagaaaggagtggtgttttaaaaaatgttattcctaaaaacttttctaattctttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcggtatgtccaagtgccccaactggaagccatttatggaattatgatcaaaactcaaattggtcttattccagagatctgagattgttttcaggtttcttttattgacaaaagttaaaattctaatactgtactgatgctctaaaaattaaatggaatatgatgatgaatgggaaagtttcccattttgatattccagaacaatctatgaaatagattgttagggagtttctctgttcacagcttgtatgtgttcactctggtagctgaaatttctttcagttttatgttgatactaatctaatttgaaagaataattttcatacctccttcaaaatgtagatttcttaatagttctagttaaggtccttatataaattataaaatattactaggactagaagatgaagaattaagtattttcaatttcttaatttgaaaacaattagaaacaagatgtgttttgttaaaacattaattttcataattcatatatattatgctcttgataagaatataaaattggcaaggtttattccacagtggatatattagttgcataaataggtaattactgactgtgattcaattttaaattattagtgataatttgtggtagaaactgaccacttgataattcaaagacttctggccttatcttgccagcctagattcttggcgttaagtcaaaacaaaaaattggtggagtcttaatgaaatcttcttggcccgttctttgatttgaaaacaagagtgggcttgtgagaagaccagttcatttataatggcatagcatttttcagtcaggattcaacaaagtggactctgtttcaagaaagtatttgtaactatgttcagtcaatggtttcagagcatttagcaagttcttatattaagcatcagactaaactctacaatttaagaaagaaaacatctagtctcataaatggaagattctctaagtttgcaatatagagcagggaagttatttatgctttggtatttcctacactgtatttaacctacatttaatagtaaaagcaaattatctacacagtgatcattaaatctcatagtagtaatatcagataattttcttccatttctatctccaaaaatagtggtctttgtacttgctacatcctcgtgctgcaaatttctcttattttcctctttacgactaaacatccacatgtatacctaaagtaaagcaatatagaatcattttcccccattgaaatcttaatctcattaagaaaaaacagataaacccttctacccacttggctaccctccttttcttccctcatgcctaccctgaggcactactcttatgaaacacttggattaaattaataattgattccagcttttaaatcctctgatgtagattagtcttcctttgttccatctaacctctcatttctcaactctgaaatggcactaaccactaagtggcatttatttacattgatttgatttggtattgtgtgttcttctactgtagtatagatgccttgtggagagagattgtctgtcttgtttaccgtggtttcatcagggcttggaagagtcctagacaagtaggtgaaattgtttttgaatgaactcaagaaagaatgatacttgagtgactggcttctgcctacttgtactaaaatagctctcaggggttcctagcgaactctcagtcaccactctctgtgactagggaatacttgaagaagagtgatcacctcttcctattgaaactctccttccagaacttcagagccattgcattgtcttaagtctataccttgtctgttctccctggagccttttcacccttccactccttaatttggacatttgcccaggagccaagctgttttatccctgactcctttgaatcaatcattcactgcttcagtgtcagtgattatatttataaagatgattcccagtcatcttagttcatttaaaataaaataaatgacatttagtgagtatctgaaatgtaaccaggactataaaaagagctaataatcttagagctgaccccaggacttcaggatctttgtgaagacaccaatgggagtaaacaattgactacaacatggtacatggcacattataagtacatacaaagtggaagaagtgattccctttgggtcaagaagcttttacagaggaagtagtgtttgagaaagacaaaaatcagaatttttctattggaaaattcacaagtgaagacacttgacaaagagcatgtgtatgcttaagaggtgccaagtaaatttgagaagaataaaggacatggcctttttttctttttaatacaaaagactgacatgatcaaagtttcagaagagaactggtagctgttattgcaacagcccattattacattattgaatgtcttattgtagtaactcatcttcctccttcctagttatcagttgactaatctatgctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctcctggcatgccatttcctttatgaaatgtcttctgttataattagattttttttttttgcgtctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaatatttattgaattgaactgagatgtgtgtactaaagctcagtctgtagtttgtccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtacttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctatagctatgttgtggaggatctggggaattcaagaagagattctgagcaggccactgggaggcctggggacagtggctgtttacccactgatattgacgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaaaatagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccataataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacacaaaatcactgtttagtaaaacacttattttgtctatgatttctctgtcttgttttaattgacacatttaaagaagaccattcactatttttactcttttgaatgtgaaaagtatatgtatgtacacatgagaaattatttttgtggcatcaaaatgtcaatgacaaatttgaattattgttagagctgtaaaactgttgtgagcataggcaaattcccttatcaaaattactctatacctgggaaaagcccaagtaattttccagtggtgtgaaggacagagagtgttcggtcgatgagacttaggaagaggacttcggaggtgactttcaggggacagtgcagtctctcaatttgtatatgagaccctgggcttcacacagctcttgtttcactgaaatccctcagcactccactcctaaaggtaatacctttatgtctggaaggttattatgcaaatgattttttaaaatattcctgcatatttttgtgctatttataatgtcatttataattcaccgcatatttacatttagtggctacattaacacttcagtgagtgtttataatgccatatatctttttctacttggtccagttctttttttattttattttttttttgagatggagtctcgctgtgtcacccaggccagagtgcagtggcatgatctgggctcactgcaagctctgactcccgggttcatgccattctcctgcctcagcctcccgagtagctgggactacaggcacccgccaccaccccagctaatttttttgtgtttttagtagagacagggtttcactgtgttaaccaggatggtctctatctcctgaccttgtgatctgcccgccttggcctccaaaaatgctgggattacaggcatgagccactgcacccagccctccagttctaattttatcttctattttgcccatgagtaggcgttttctatattttagatattagcaagaccattgctgatgtggaaacagggccagtgtgtcctagttcttggctgaggtcttttattccattccaccatgtctgcctgcatgaggcagcaggaatttacaagttatttttctttatgtgtttctttattactttgccccatcttctcttattttatttttctggggtggatgggtaaagatactttgtgttcatggcaagaagtgtaggattatgaagaaagagactccaacattggatgcaaatcacacttaatgtctttttattatgcaaatttttgtggtactttgcatagcaaacctaagttatcttggcatttgtcatatcacttttcaattgttctcaaatggaaaaaaaatcagactctatttcctgtgtccttagaaaagcaacacaagccattttctaaaaagatgaccaattgatttggcaaaaatttagtgtaaaactcatcaaaagcatgaaaaaatcggtcagacagactaatgtacctgacatgaccaacagcagatcacattttttatttcatatgtaaaatagacttgaccactatttatcggtttagtttcttttttcaccttgagccttattatctgacttttagactatatgtctgaatatttttagagcagaaccataacaagttctacaattgtaaattacaagctgtactattattttgtgtgcacctgaaatattaatatatcgtcaaatcattaagtgagcacttctgttttatttgtttatagggtacaagtgaaattttgttacatgcatcgattacatagcgatcaagtcagagcttgtgggtatccatcatccaaataacatacatttttacccattaagtaatttctcatcatccaccccacacaacctctttcccttctgagtcttcattgtctatcaaaatgtagcaggacgagccacagacaaaactcttcggacgccgagttaaagaaggaaggggtttatttggtggggggcatcggcaagactcctgtctcaagagccgagctccccaagtgagcaattctgtcccttttaagggctcacaactctaagggggtgcacgtgagagggtcgtgattgattgagcaagcagggggtacgtgactgggggctgcatgcaccggtaattagatcggaacaaaacaggatagggattttcacagtgcttttctatacaatgtctgtaatctatagataacataaccaattaggtcggggtcgatctataactaccaggcccaggatgtggggccaggctgtctgcttgtggatttcatttctgccttttagtttttactttttctttctttggaggcagaaattgggcataagtcaatatgaggggtggtctcctcctttaattctactttatacatccatgtgaacacatttttaaagcactgatttatgagtaagagcatgtgttattttactttctgtgcctggcttgtttcatttaagataatgacatcccccaccagttccatccctgttgctgcagaatacatgatttcattttttttttttatggctgaatagtattcgtgtgtgtgtgtgtgtgtgtgtgtgtgtgtgtgtgtgtgtgtctgtgtgtgtgagagagaacctctttgacacagaacaggaattggtattaggaagggaaatttgggggtatgacctctgttgttaatgagtctatagagcatgggaatagcacaggatctggaccaggctgcagggtttaaatcccaggtccacaacatcctggctctgtcaccttgagcaggttataccttgtgcctcagtttcctcatctgtaaagttggagtcagagtatttatttaatatggtggttgtgagagttacttgggtaaatctgcacaaagtccatatcacagtgcctacattgtaaacatagtataagtgttggctgacatactaataattttgatttatactaaaagaatgaaataaaatgttcagataagaagtaaaagcaatcattaaatacctatgttctgtatattgtgtcccaaattaagttgcataggcttggaaaacatttattgtatatatttcaaaacatatctttctcatttgaataatgatagctagaactttattatataacagatccaagcgtaatccaggaagagtctgaatctatatatgtgatagccagagattgaatatacccaagtgtcctctgtatggaaaaaaatttatctgggcctttttaatattttggctgaaaaggctcatctgtatttttcctaaatatttgccttaatctagatcactcttgctaataacaggtactgtaagaattacatcgccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacaagggaggctgaggcaggagaatggcgtgaacccgggaggcggagcttgcagtgagtcgagatcgcgccactgcactccagcctgggcgacagagctaaactccgtctcaaaaaaaaaaaaaaaaaaaaaaaaaagaattacatcaaccacttcactaccaaggcttgttatttttttcatgtgttatgaagaatcaatatataggaaattctagagatgtaaccacagtggtggaagtataaacccagccctgattaaaataaattgctgtcttcccttcaatggctataaaatacttttccccactccttcttctcacatccctcttctcctcctcctcctctttctcttccttaccattcctgctcctctgttcctgtatgtatatattctgcacaaatctgactccagttattccaaaccaattgccattcttcacatgtgccatgctgcctattgcttccctgcccttgcacaggcatttccctgcctctaaattgcatttccccttttcttcacctgtctatgacctatggatactttaatctcatcttgggcatcattttctatgagaagccttttctaatttccaccacttcctcctcatatgctgtgttattagtctattcttacttgccattcctccccactagacaatgagtttcctattgtgatactgccctgttttgccagctcctggcaattgcctggaatatagtaggtgctcactagctgtccgatgaatgaataaatgagtgggcatatttgtatatgaaagtttgaaaaactttgtacaagtcaaaagaggctagcctttgtatgtctaaacaaagtaaatataggtgtctaccatttctttttaactgaaaatagaaaagcttttgcatttttaaaattttacattgtttagcatggagttatatatcaaagatatttttatcctcattgaaatagtagcccaaaattaccactatagttgataaaatgattttcaatttgatggtaataagtaatatcatgaagacaaactactttaggtttctattaaataaaccattgcatataagtaaatatatgcataaatagacaatacttggtaaaataatgaaatgctcttgcaactgtagaatattatttttctcctttgtgctatatatttatagcatttaagcaaccatgtcatttactcaggttttcttatattagttgatcagatcttttttcccttggtatcatagtctgacataattatcaataatacagaaaggtgataaaatcattattttacagaacaaatcctttttctgaaatcctgtgtgtctgtgtgtgcagatatctctaacagataccttaatcattttcattggaataggaattaaaagtcattttgcaaataaggtaagtctagactcccaaaataaaaattcttatgatcaaatattcatagattatgaggttattacatgcgaggcactgctctaagcactttacataggtcatatccttttatgctgagagtggtttttattatgatcccattatataggtgagggaattgaaacacagattaagaaatgggcccaacctagtgtggcagtgcccagtggcagagctcggatcagaccccagtggtctggctgtagagcccgcgctctaatcattttgttacactgcctctcagatgcttccactctgctttcttccatgtgcaaactattgtgtgcaatcctgtatatgatgatgatagtattttatttttttctgtctgagaagactgttatttttcataaaagagagttttcttatgtgatatgaattaaggttcataaggttagttttcgaagttgcattctttgtatcaagaatttatttttccattgtttaaattattggatagatgttgctatcggagctccacaagaagatgacttgcaaggtgctatttatatttacaatggccgtgcagatgggatctcgtcaaccttctcacaggtaaggtactattctatttccaaaagaagcattggttataatgcatatccttaaaacttccagggtttatgtggacttatttttcttaattttctcattcaaatacttaacactttatttcaccgtttacttatagtggcaaatgatcttattttaagggattaataactcttcaaactccctttctccataaataagagttgtagttcatttccaccctagcttgtctatagcccattaaagatttctctttgtatttcattaaattgcattctgaggtaatatccatatgattctaaaatatgcccatttggatttgattaactgtgtcttggccttgtggctagagccccatattttgtgaagattgcacagggagatcaaacacacatatgattctctgggtttttttcactgttgagtagtaagatgatagcactttaataatgtctcaggatcttactctgacttcacttttgtatgttgaaaaatcatggcatttcagtgcctagaaaaaaaatgacattcatatgcagagaagaaaagtttttcccttgatatttgcatggaaatattagctggcacagttatttttgattagaaaaatgagcaaatggttctctgtaattgacataaaagaaatgtatttgtctagtaaaaaaactaattttcttagcacgaatatcagcttaatatttataaacctgtatgtgaacatgaaattagatatgtggaatagaaagtacatatctggctagggttgttcttgttaaaaagtcagcttttatcaaaagcctcagtcataggctccactaagtgattatagacatcttgttttacaaattcttatttagttattcatgttgggcaaggaagtaaatagagagcctgaagagacctaaggaggccagacatggtggtacacacctgtaatctcagctactcaggaggctgagctgggaagactgcttgaacccaggagttcaaggccagcccaggtgccatagtgagacccccacctctaaaagacttgagagggagtaaagactatttcagaaaatctgtacagcataattttccctttgctcgcaaagtaaatttttttagtcacaaatgtcacctgttcatttcaagctggaaaaattttgtcacccttagaagtatttgatttaactaaaatgcagctttgttagtagatgtgccaaggcatgcctgggaaagctcattatttagctaaatcattgcttctctggtatattagtattcaaaaactacttcccactcaactttcctatttttcagagaattgaaggacttcagatcagcaaatcgttaagtatgtttggacagtctatatcaggacaaattgatgcagataataatggctatgtaggtgagtaattagtttatcataatttataaattggaataagctctatcatagatactgctttatagtgaagtacgtaaaactggtatgaaagacttcatcttactgataattttttttcttcatttttaaagttctccttaattcattcctaaaatgatcaagtaattcctcagcttaacagtgctagttacacaatgttatagtctgtgtttttgaaaacatgaaagcactcatgaaaatcaaatatatgaggaaaagaaagaaaatttttatttagaaaaatttgagtgaatgtttctagtccaaaaattgaattttgttttagtaaacttgtttttgtcataaagtttatgatatatcataatgggatgaatgttgtacatgaatagattcagagaaaagtggaaagaatcgtaagatgttagcatatattctctaattttctataaatagtgttttaggtagtcaaaggtgatacgtagttaagtatttatggctgaaaaataattctctttgactaatgatgatcattaatctgtgttgttttttatcctccagatgtagcagttggtgcttttcggtctgattctgctgtcttgctaaggtaagactgatatatttcactgcttaattgcaatttggtttaattgtaaaatgatgggaggtggtgtttaaaatcagcagtggtagtgacctcatgatgctcttttggtattctgaagcttaattattgatttttagggtatttttttcaccttacagagatataattaaatcatcaaagtcaatatttttagacatttaaataaaaagttattttgccctgtgcacagaaatgtaattagtatgtacacacataataagactcatgaaattacttggtgaatgtaaactgaaaaaacaaacgcatttctctccttaaggaaaaataattctgcaattaacattgctacttttatttccttctcaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattggtgggtatgccctacaatattaatgcttgatggggtgcggttcattcattaatcccacaatcctgcttggagccctcaccggttttcaccacggagatcttctttagagcgggggagagaagctacctgatgcatgcttttcctctccatcttccagattcttgcgttgttctaaccaatgagttgggcacattagaaggctgtagttgtttagagattatgagaagcaaaggacatagtatcacttgctatattagtttaaggtaaaccaactgagcttaacctgtgaaatctctttcttcttgacattggataaaattgacattttatcaagtgtcaataattgaggaaagccaggcatggtagctcatgtctataatcccagcacttgaggaggctgaggcttcagcccaggaggtccaggctacagcaagctgtcatcacaccactgcattccagcccgggcaatggaatgagaccctgtctcaaaaaaataataaccataaaaataaatattaaaaaaattgaagaagctagacttgattctgatttctataaataatatgcttgttaataatttactgcgactacaagctcctaagaaccgtcacctatgtccctctgtataggcaactctcaattatctgctctggagaaagtatcattgatatagctcatccaaaatattgtggtggggaatcccaaatcatgtatatatgactttataagtatttttgctagcagattaatgttcctaattatgttttatttaggctaatataagaataactactagtgaaatgagcctgtggtaggagaagagcatatctgggcatatcatttagagattaataattcacaacgtttatgatcccctattaggacctgtcaagagtttattgtattcatgaccctgcaggctgctgttatctaaacatcgtgaagggcccacatacttattaaataatgccatggatatgtaatagaggtcttagtatgcattaggtacacaatgagcctgtacctgaaaggtacacaatgagcctggcatctctactttagatcagactcatttttaatagtgtcctggaaaagtcatggccagagctacagtaataagagggtggacaagccttcatctagttattgattggaaaatggcaatttgagagcctgaccacagagtaaattacacagtaacacagacaagctgaaggataatctgaaagacacacattgagtagatgacgctctttccttttacataaaactagtgtttcctctactaacaattccattgtgaccagatatttttaaaaatagttgaagacaaacatacgaaacacataaataatcatcacattattggagaagcataccttataattatcataaaatgactcccaggagaaataattcacatggcaagcatgtttaataaaaccaggacattttaactcttactaatagtggattttttttcacctttttcatttactttttttctgaactcagggcaatgaacttgtagacagctatatcaattgcagtgctatttctctgaggtattgaatctcagttattataattttgaaatccaattggcttggacttcattattttccaactaaaaagatgattgaaggatttatttgaaatgtgtaaagagtaatatagattttatgcttatgtttccttgaaaaaagtaggtaaaattcttctggaagtgttactcctaaaatacaaatgaacatgtcaagaattacataaattctttaaactatcacttatgaattattgcctctatgtagtgagtgacacctcagcagactattagatttagcttgcatggcaaagaactcatttagattcatgaaatggttctcactttcttggtaagatctggcttggacgtttttgttaattttttcttttttccttttttttttctttcaaatttggagatcttcatgagcagatgaatatttactatttcagatttgaaataaaccctgccaaactgctagaatatttattgagagaattttttaaaaattgcacaaattaacactggaaggtcaaactagaaaccaataacacacagaggaaggacagataatcagggcataagactggaaagatgacatttttaagaaaaccgtatatatagatttgacttaatcatgtgttcacttcatgtataaaaaaaagccttcaaatcagaaacaaatctaaaatataaaaaagtcatatataaaattagtcatataaccacataagatagaattattccaagtgacatttgagcaaagtgctgtgtctatacttccttagtcaatgttctgagaaaaaaaggaatatgaaacatgcaagacttttattagcaacaatttttatatttttgaaatttttatataaagattaagcaaataactaaagattttaatgttgttaatagaaacctagaggaaagttcataaatctttataaaagcaatttttaaaatttgtatttttaattgttccctctttcatatttcaggttagtctttaaaaagctgtttaataaagagaattccagatattatttccagtagtccatataactttaactattatcacttcaaaaataacaatagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcgggtaatgtaagctattttttattaatgaatatgtgaacttcaacgttgttgatagagagcaacttattgtattggtatctttttataaaatgtagataaaagcaactgttacccctcctgaactatgacctgttgctccagttaaggtatgagacaatctcaacccaagtaattcagagtcctcttattgtatcatcctttttcacatttatcacatttgacctcatcatttgaaaacacttgccttttcctttctaaaatttcatttctcctatccctctttatctacttgcctagaaatatacatcttcagtagctcaactgagcctcaaatctattccgtggtacgttttttggggtgggtcaggggaggcagggaagttagtttgtttttcatacgactccagcgaagcagaatccaacatgactgcttttgggttatgtctttgtttccgtgccagctttgccagtgatgtcagtgggaactcacacagttgtagcatggtggggatcatctgtgggccaggacgatagctctcatgatggtttggggtatgtcctgccaaagcacagccgatttcatgtttcttttattaaaacactcattcccaaactgatcatcacattcctcacattggtcaaattttatcatatgaagctgtgccaggtctttttcattagggaacggtgtacttcatcagaaaatctattgtcacaaaaaaccaaactattcccaggagccctttctgggatttcaaatagtagcttcagcttagggcttaattttcccttagatacttattccaagcaaatgcaagcaagcatcaagactccaatacgctattaaatgctaagagcaataatccccatgctatttcctcatttcccttaacagtttttattgttgtactagaataaacctattagatggttcagagccaaaagtatagaatattaatgtaaccatcatttatatggtaggaattaaagaggttctttttttcatgcttcatagatgtcgttttacttaccttagtcaattgtagagacaaatattgaaatcattttaaaggcaataaaagggccaacattagatgttcacaaagaaatacattgtgttaaatttgtaaaagtgatctggtttatttagtcctgtgtttcttggcatcgttcctgtaaataagggatcatcaaaattgtacagctttttcggagtaaatttgtagcagaaatgattagcagaggtaagtgttgtgttgcatgtatatttgtagtgttaccatggctttgatggtagcaggattcagccattgcctttgtaccatattgcaaatattaaatgatagcacttactgctgggattgtacatggcagggactttttaagaaatgctcgtttccttcagtatctttttctcttcctaagttaccttgcttgtgtttggaacacttttaaaactcgtatatagaaaggcaaaaagttactccaaccctctcctttgtaacaaacccacacagaagataagaaccacagttgcagctaccctgaacttgagttctgtcaaggagctgtagctgttacttaagaaggtataggaatgtaatgattgtactttcccacctccaccagggtaatagcccaaggcattaggaaacattaacactcttaagtttctacagtctgaaagcataagacagcaacctgaattcttccatcttcctagaaaagaagacgcatagcggttgggatgcctgggttgctcctgtgttccataaaacgcatctggtaccatggtaccaggagtgggaatgttaacatatgtatctattttatctctgcattccttacaatgaaatgaagtggcacttgttaattatgtactggggcccacaacccccacttgtcagaggactccctgcctgtctgttggttggacatggtttacttgtgtagatgtccctactggccattcactccattaatttgataggtatttattgagtacccacattgtgtcaaattctgtatataccagtgaataagacataaaaacatcactaccctcatggagcttatagtctactggggtgagaaaaaaataatatgataaaaatatacattttatagtattttggaagatacaggtgataaaggaaaaaggagggcagagtacagaaatgtgcagtgctgcagaaggagtgaagcggagaattttaaataggatactcagaataggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaaagttcccagaggacccatactttgagaacagctggttcaggagaagagtattccagcgagaaaagctgagtcaaaaggcctcaagaatgtacctggttattttaaagaacaatggggaggcaaggatggctagaaatgtaagcaaagggaagaatggtggaagaagagattatatagaacctgtggctttttctctgagagaaagggggatctataacagcattttggcagagaagtcacatgatctaacatacgtatacaaaggaacactctagctgctgtgttgtgaatagagtaggagatcaagattcgacacatggagaagaggctactgtggcaacacaggtgagaggatggttccaacaaaagtggtggcagtggatatggtaagaagtagttgaagtcaatttgctgacatccaatttacaatttgctgagagactggatgtctggcatctgagaaagaggctctgtgatgactccagggtctttagcctgagccacttggaaatgtagttttcatcaattgagacaatattgcaggagaacaccttttgagtggaaaattctagagttcagtcgtgggcctgcttagctagagagacctattttaaatgtaaatatcaactaaggctttgtacatactcatcttgagttgaggacaggcagagaacaggaaaggtaacttaatatatctttggcatatggatggtatttaaagccgtattaagatggctgagatcagaagagggccaccgtctgtactctgggccgctacaacatgaagaggttggcaaaaagaggcccacagaggagataagaaggtccaatcagtaagaaaggaagaaaatcaacagtgtggcatcctggaagtgaagtgaaaaaaggggaaagcatgatgatgttttctatactgcagcttgatcaaataagatgagggctgaaaactcaacattggatttataatgcagaggctgttggtggtggtgacaacagcatttcagacattagtgggggaacggggggaaggaaaggaattggaagcgtcataggttattctttcaaaaagttttgccacaaaggtgaccaaagaaatggagctgggggtcagtagctgaactggagtgaagagttttttggggttttgtcttttaagacaggagaagtattagcatgtttttatgctgataggcatgctgcaatagagtgaaaaacttgggatatatgtgacaggggagaagagctggaactaaattcttgaaggcaaaaagggaaggattaaatgtacaagtgaaagggttggttctagataggcatgtgcatgattcatctgagtatgtgcttgcagatgctgggtagatgtggtgatggggactgtagaagttcttgtctgattgctttaataatctcagtgaactaagaagcaaactcatcaactggagtagggatggaggaagtggcatttggagtttgggaagatgtgaaatagtcttctaggagaatgggagagtaacaaaatacaggatggttgtcagatggtgtttgggaccacttgcacttattgtcataaactgagtgtagcctgtgtgcttgtgttttttttcccagtcacattcagtcttgcaggagtagatgaagagttacaattaaccagggttgtagtttggtcaagagagtgaagcaagcaaggagcatgcagcgggagggaatgtacaagggaatggttatatttttagttgtgaagttgaagcaggctaaggaggggagggggcacaccaagacggtgagggaccaggaaagaaatttgaattggagatcccaggacaatcagcaaattgttggaatcgactattaaacggatcgagctgcaaagatggcatagatattataaaatacaaaagcccttggagacctaaaagtgaggaaaagattgaattttgcttttatttttgctgacaatactttgattaccttatgcaaacaaaagcctttaaatttacttacaaaatccattgtgttctttgatggcggggaattcggctgtcaaaaagactccagatcttaagtttaaaaaattattctcttttaatcacaattctttagttttatgctagatcttcttggactagaggtgcatttttaatagtctaataaggatctatatcactggcatgtagatttttgttctggcatgttatttttctgaggctatgttttcatttatccggttagtaggggaatcagttttcttaagtctaatcataatcaaaagagtatcacacaggattactttgcttaactggtcaaaatttgttcctcataaaataagaaagaaggaagaaattgtctttttttttttttttttttttttgctttaaaaaatcctttgtattttagttgattataattatgccaagctttaattttggccaccagagccatacaattattagattttgctaatgagttagaatgatatttctgtaatataaaggaaatggttaatttcatttatatcttttagtgttttatctattgaaatcgtcttctattagacattgctttttcctctatgaaaagatgtttccccatttatgtaagtatatgaaaatctttgtttttgctttatttaaatatacaacttcatcaaattgtggagatttcttaggacaagggataattttgaagcagttttgatttagggaaacccaaactgtaacttgaagcagtttttagacatgttagagcagccatggtagtgaaacttcccttgaaattttgacagatgatatctcttggttgaacttgatggatccctgcatcaaaatatccactgatatttgagaggagaagaagggtgctacattgggataacaaaagaagcaatgagatttcctgtttgtctgcatttccaacaaagctagaaatactggcttagttgctgaacaaagaatgcctgtccccagagatattctgagagccagtgaattcagtggccttcgcatgttttattaaaatcatgacatcaatctacctgggtagattagttaattcttttctttgatttctcaaatttctgaattttagatttatgaaatgtgggtttattttgttatgtaaatctttaggtgacttctaaaactcatcttttttccatagtagtttcaggaaaacgtgtatttgattagtaaatacatttttttgtaattttttatttcatttgcttatattgttgagcaatacatgcacatagtttaatgaaatgtcatttactccaaagaagaaattttttaacaatagcacactatggactgattcatatatgcagacatttctgtggaaaatctaagtgtgagcaaactatatcactgtactaatattatggtattctaaaagtgaattgattattataacatgtgaattcttcattagattgcaagatctttgaggcaggatattatcttttgcatatttatattcttagagctagcacaatccattacataaggcagaaacaataaatatttaacaaatttatggatgctatgttcttggtgctatttaaaaaattctataagaaaaatctgagaatgttctattggtataatggttagggcatttgtcttaggggtgctgtcttttctcaggaaattgtaatgctagatgtctgactgttctgtaccacttgagccaagcttactagataaagggactgcaattatataagatggtgatggttcaggtaccaacctgtgtcttggtctcagcttttccttcccgagccctgcattagcaccagagaggtgtttccaaaatctagtcatattccttgcttaaaatcttcctatgtaagagcctccccagccccttttatgtgtagattaggtggccctacttcttctgtatttagacatgcctctgtcagaatattcatgccccacactgtctatgtggatttgtggaacatagattgtgacaggtactgactttcagttttgtaaccctagagctgccttggacacagtaggcccatgaatagatatcttcaaatatttattcctgacattattttttatttagtgatatcttataaatttttttgccccaccaagttaacaggaggacatgggcctgttgctcagctctcaagttggccagaaatacagatttccatgaaagtcaagcaagaagacagacattatgtaatttcaggcatgtgctaatttgcacgcttgtgggcaccctattttatgtaattgtccataaaaatgtggcatggaatcttcattatttttaatatagatagcacatgcccatccaaattttaaaatgtaaacaaatctacttttttactcccaaatatttaattaatcacttcaagacatttttgatattacagcttttgtccttaggtggagctgttaaagttaaataagtgtgaatatctgtcaaatacagtttttgcaagagtgcatgtacattttatatattgtaagaaaagcgtaattaatagctaattaggataatgaaagtaatatacaacagatgtagagaagaccttgtggaaaattagtatgaattagatagcatgtgatttggtcaaagtaagcttgttgagaagaattaaaacagtggacatgtggagggacaatcagtggctgtctagctcctcctacacctagggaatgatttaatcaagtttgctattacttgaatactcagggcttcaagctgttccgttttcacaagtcgataacttgggatttggccttgatttgcagcattcctatacggtcaaagtttcatgttgagatgatcacttaccaagtaatttaatataagaatctctgtataagaatggaaaagtaatcagggatcttgagtactctcaggctccaaatcttctaaataccgtttaataaatagagctctattccttgttctataactaattttctatttaatgttgatggttggcagtagtagttcagttttcttattccttccaaatgttcaccagaatctcctattctaggaaactgaaatttagtaatttcttagctggcttatatacctgaaatttgaagcaacatacaaatcttgtcaggtctgctttatggacattatgtcatttaatcatcacaacagtaaggtataagtataaccaccataattgttattattcctattttcagataacataactaagccatagacaaattaagaaacttgtccaatgttatgtagataataagtggtggaccccagatttgaacaccagttcttcaccttcagaccactattgcttttaaccactatatacataaattgataatgttgtaaatgaaaagagaaaaaagattacatcctttctgtttataattacataaagacatagaatagatatagtcttttatgtggtgtgtgtcatctttattaaattacttcgttgatttttatcaaaagttactatataaataatatagcaacacagcaataatatgtgtgatagggatttattccctatttcttaaggattattaattgatgagctttgaaaataatctattccttatctgctttggggcagtaatgtttaagccatattgcaatcctgaaatgtctatagataaatagaaacctggtccactgacattacttagtaggaggtctgtcaattgcagtgtcatgggtctaccttgaggaactcatctagcataatataaaccttaattatggttgaagctaatatgtctagcctgggtgaaaatactagactctttaatggtcaagagggaatttgttgaatctattttttaagatgagaagaacttatagattgaaacagccatatgaaaagtagagtcaaaaactgagccttaaattattagtatgaaagacatcacagtctgtgaccaattcatcaaattatctcctgcgtatagcaacaattctaataccaagaaaaacaaaaactgcatagattttctccacttgtttccgtgtaggtgggctatatgtggtgatgtgaactgctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataaggagaagtctgttttgttgagtaccctttgaaaatcacatttctgtctgcgtagtgcttgaacaggtgctttctaagagacactgtgttttatatgctacctgattttcatatacatttgccctgcagtaaccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtggaaccgatgggtacagagggctgactctctttgttttcatagacttgagagtctaggacacttttactatctagtgaagtgcttacttaatcgaatgacaaatgctttcaaagatttttttttgtttatttcactgtgtgtaagcaaataattttgaaaataatgtggaatttttttaatgaggatagcaagtaatcaaatgaaaagaaaatcatttgtaagttgatagaaaatatttttaaaagaaaataatgtctgcatatagaaataaaggttaaaatgtaagaattgtcaatcagttgtaataaactcgagctgtttctttggagacagaagacaatgaattttaaaaatctgattattgaaaaaaaaaacttgtgaccacatatcaacaagaataggagtaagaaatgctgtgtagacataagatattaagtttaaatgaatgttatacagagcagaatggattgtgaatgggttacaatttctgtgtaactggtaaataaattcaagagttctttgtgaagtataaaagcacaataaacttagaaaaaacaaaaacggctgggcgcggtggttcaagcctgtaatcccagcactttgggaggccgagtggggtggatcacttgaggtcaggaatttgagaccagccctaccaacatggtgaaacctggtctttactaaaaatacaaaaattagctggatgtggttgtgcatgcctgtaattccagctactcgggagactgaagtgggaggatcacttgaacccaggagagagagattgtagtgagctgaaatcacgccactgccctcaagcctgggtgacagagcaagactgactcaaaaacgaaaaataaataaataaataaataaaaactttaacaactaataagaaaatcagtgaagcgaccagtgtatacaattagatgtacaaaacaaatacttttcctatataccattcagtatctgttagaaaagataatagaaaagttccataaagaaagaaaagggctgggtatggtggctcacacctgtaatcccagctctttgggaggccaaaactggaggagcccttgagcccaggagttcaagactagtctgggaaacattgaaagaccctgtctctataaatatgaaaaaatgggctgggcatggtggtacacatctgtagtcctagctactctgaaggctgaagcagaaggatcgcttgagcccaggagttcagaactgtggtgagctacacttcactccagtctgctgacagagggacacatcccatctcttaaaaaaaaaaaaaaaaaaaaaaaaaaaaaaaaaaaaaaaaaaaaaaactaaaaaggatgttttataataaatctggagtcaaatgaatcaaattcaatcaaaatgttgttgagagatataaagagaaaatgtatagggtaaagttaaatgggataaaaagcaccttgaaatgatttacaaaaagtttatcatgaaaaatgcttatgttataatatcaagttatcttttaaatgcgtagaaaatagcatggaagaaaatactcccaagtacagaactttataactattattggatagtattatttttcatttttattttttttgtgtttttcataagaaacgtaaatgattttgtgtgatatgaaaaaatatacatcttcatttttttaacggtttagataaaagataagtatttgctttgtcttccatgtatagtgtttggcccttttcaggaaaggagttttatttttttttaatctacgtgcttgtttttgttaattcatatggtggttattttccttagaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacagtaggaatattttcctttattcaaattattgtatggcatttaactaaatttttaaaatatggcataattctgaagaagtgaactatatgtcggaatttttaaaaatacgaatttttaaaaacaaaaatagatttattcatttctttaaattgtttatattccctttaggatattgaactgaatattttaaaatatgcatttaatcacaacagtagattctcatataaaatgctgatgttctatttttaatgccttgccagtgaagaaagatatattactagagagaaatcataatgggagaagattgtatttacaagttagttattcagtgtcatcatgtgtcctcagtttatcttcctcttctcattttctcccttgctttcatcctactcacagattcactcatgtcttcataatcaaattttcttgcttagttttacccatttacagacacatgtatttatgttatacaataatttctttttaaaaatttcattatatgcttttcagccacatcccaggatcaattgcatttgagatggatcctacattctaaccagtgaaccgttttctaaattatctcaaaatatttaagtttcactgacagtgtatttattctcaggagtcctgttgttcagacctttagtgtctatcaacacaaagacatagggtttgtccaaaaacaggatgtgtctgggcatagtaaaaagccttcattaaaatgttcactaatgacacacagaatgtaaaagatgaaagggacatttaaaggtctagttcacatcctgtccagacaaaattgccccatagtcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaatattgcaagtacacaagccaaaaccttagcaattggtagttatattaatttatattttgattcttagaacaacctgctttaccaatagaaatggcagaaaaaaaaatcatatttatttagagagatatttacacctctcccccagctgtaggcacgctatttgacagtactctagtcacttcacacttaatgagcctggctccttctgactttctagatctctctttgttttctgcatctgtctctctctacctgttcccgttaccttcccttttatctctccccattttttccttttgcccagcttatgccttgggtcttcctaggtcctttgtagtatttattgatcttattaaaaagcttcgagttaattaaattctgaaacccttacttatttaattttgttcaatatttcctctaagtaaaatttctaagtatctccatgtagctaatttcaatgaatataaaatcactgtcccaacatctgtcacaattaagtgccatacttacacgtaataaatgggatcaaactgcagcaacagaaaattgagaggaacccaatgaaaaacatcttggcagctaataaactcctttaatgcctttcatttaactttttttccaaatcttatttcacttagaaaatttgggctttaaattttacctatttagaacttagctcttttagccctgcaagtaattgtcatttgaaccctactaattctcaaattgaactttttaaaagagataaaataaagagttgtcaatttgatgtatcaattttatttttctcatgcatcacaggtgtcgtcatctttaaaatatatataaatatacttgctgattaaatcaaaataaaaaacgttgtctttttatttccagataaactttgcaaggttttgtgcccatgaaaattgttctgctgatttacaggtttctgcaaagattgggtttttgaagtaagtatatgtggtatatagtctctgttattcatcgagagggtgtaatgagtgtgtgcatttgcattcccaaaagaaaaggaacaagagctaacccttgaaaattaacagcgtttaaagaattagcaacacaatgcttagttttttatcggccagaaaactggttatatcactcagactgatatataatccaagtatgacaaatttaaaaaggaataaactatcttgctcttctaaattcatagaaggggaaacagagtaaaaaggaaatagatatgtgttttagaatagcatctaacacatagcaaagactggataaatgttggttgctgtcgttattttataatggcaaataaaccactgcaattttgtatcatatctggatcccctatattcaaatcattttgcatatcaaaaagatgatgtgaaaacaaggaccagagagagagaatgaacacttcaggttgaggattgatcatagaaggcaagtgaaagaagggaagaagatgcatcagtgacagggcagggaaacggggaactatttttgggagattgggatataaatggagcagctttaatctggggcatgttgaatttggagggacttttctatgtggcattccacttgaaaatctagttcaggattatgtttggaagttcctccatatattagtgacttgtgagatggcccaagggatagaaatgtgaatttcacagaggaaaaaaattacagatcaaatcttggaggacagttttattcaaggagattaaaaagaatggggagtccctgtaggagactgagaaggcatcttcaaggaattaaagagaaccaagtccctggtgaaatagccaatggagaatataaaaagggagacttaatattgtaaaatttataaaaagatcagataacgtaatgtctaaaggtcatggaagttggcatttattaataaaatgtgacgggtggtgaaaaaatgggtatcactggcaaatgttaagatagaactctcagtgcagaagtagccaaatgacaggattagtgattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttttcagtccatacttgaattccactctgaagcatttcactgttcacttcctcttttgaatgtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctacatatcaaattccctattagacatgtccttttggttgccctatagtttcaatctgtccaggcactatccaggaatgacatggacattagaaagttaccaaagccagaaacctagggctcaatctgcattcttttctctttcttatttctgatatccagaattattaagtactacaatactaccacctagatgtctttcttatccatcatgctttgctatctctaccactattactccaaactaggcactcactatcctacctaggtcactaagttctcctgctttctaggatactggcctttgattttgcattattaacatacacatgtgataacagtgcttcagtggctcattttagacttaaaatctaaactcctgggtggtatttttcaccaattccccaggaagtttttcatcaatggctgaatacttatggtggtttggctgtgccatgctctcctgaacctctgtatcttctcacttcttctgcccatctacctgattaacttttatttatcttttaaatctcacctgtttcctaggggaagccccctggtcttcagctacttaaacttaagttctgttgtgcccttggtcctatggccctgtgctcacgattattgaaagtctgtctccacactgtcctggaagctgctgcaaagcagggtcctgtcatttttgtgttcccaatgcctaacagtgcctggagtgctgcaggtgactggagaggtttgctgagaatggaacaagatcccaaaagggatcagattcataggtagaggaattagccttagttaagaatctccttatcttgagctaacaagctatgaaaatatgtttgacattaagaaatttcagtgtggaaggaagggaaatacagagaactcatggatggctaggataaaaagcaagtttatatgtggtaattgaaggcattgaggatatgtttgggaactgaaaggaatggaaaaaattcaaaatagattaaggacagggagtcaactaggaataagtaaaaaggttgacaaatagggttgagtaccctactgtggtaggatcacatatggctgagaatcaattattttcacttaggcaatgtcagtttagccttgagagtccatagttcagggccaaaaagccttgacctatttgattgatgattggattttatacttaaattacccagattaactgtaatccagaaacagagactacggactactttgtatcccagcatgtagggcagtgcctttattgatttcttagttgaataacttataatcttcccatttctgtatttattttcttcctaaaccgcttaattatcttggtgtttttaccctcatgggcctttgataagaagacgagctgtgtgggggaaatcttttctaagctgcaagtaaaggagtgttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaacaaaatatctgctttgcatttttaatttagagtgataatatttcttgcagcctatcaaacccattatgatttttaaatggcataatgattttaaatgaagtataaggctgtgtttcttaaggtgttgtctctgagccacctttatgagaatcacctggatgcttgaaagaaatgcagattcctaggccccagaccatccacgtcagaactaaaggggaccaggccacagatcttcacaattaatagagctccaagttcttatcacactgaaacctaagaaccaatgttatggtggtgaagagcttccagatttgaagtcaatctgacctggttcaaatcccatatctactgtattactagtgaccttttcagagaagacttttaacttctctagacctctttcctcattgctaagtgggtaaaaatagtaccgactcattaaggttgtcttaaagggtaataatgcaggccaagtgcctagtgcaaagcctgatttccatgaagactcaataaaagtcattactatttctatttttgaaatattatggttggaatttctatagataagcttttttagtttggccataaaatgaaacattgccaattctatacataattctgcatataagctttatatcctgaaaatatagctgctgtgactggctcagtagttgcagtcttacaaggtttgaagtggcatgaatgtccatataaagtagtaggcgccatattttttgtatcaactaagaaagttacaggctatgtatttctattagataaatgattatttgaggaactttcaaatgagagcccttctaattaatttcttagactcacagtgaaaggttctgacaaagtgctttgtgttttggtaaattatactctatcagacagaaatatgtctctcccacagaggtgtcctctctcctttctcagaaacagtaggcgaattgtgaccatatgttccatacattctcccagctataactctgctggcactaatggtatttatgtgccccagagctataaacctgttttaggtaaatgtatttactcagtaaagaacatgagtttctgaagactgcaataataaactgtcaacagtacgctaaacagtgcttatccactctctctcatctcttaagttgaggcttcctcctgtatgtctaaatgcttaggacaataaactgcatttataaaggacttgcagtgcaaaataaagatgaaccaacacgacttcaagattacaaatataatagaaggtattagccatcacatagggagtttaaaatcaaatccttgaaactcatgtaaatgataccgcaatacatttctgcacctcagttgtgcttccagaatgagtgatgtaagctttccctgaacaattgcttctgtatctgctaggaatacttttaattgcaagttttagagtaattaactaatagtgacttaaacaataaagatattatttcgcataataagcagtcttgaggaaggatgttcacaggtttggtgaacagctaccaaagactagacattgatggttatctttccagctctctcagcttttcctcatgatcacagtatagccaagcagcatcaagcttccaagcaagagaaaagggaaaagagcaaaagtgcttggtcatctttaagttgcccttccaggaagggcagtgcctcatttgatgtattctgattaaccagacgtgtgttacctgtttatccctgattctgttatggttgaaggagaatggagtcgtcatgatcacagtaaattgatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatctgccaccatgctgttaattcccgaaagagctagtgtgatgaaattgtccatttttaaaatggaaatagtacgaatatttggctcactgacagcataaagttttgggagaatgaattatatgctttataaactaagacatgctaattactggttcaatcttccaatttaagtttttctgctgttcttcccttaacctcagtgagtttgcctgtctttaataaaatcttcctaaatgtcaggtaacctgtctattccaacaggcaagaatttttcagtattgtctttttccctgaagtcagtagtaaaggaaaaaaagataaaaattgtacttaggcctgtagactacttgctgcaggttactcttttgtcaaataaatgagtcatgtatcttgacatagtgaagtatggtatcagtttacattatattttattctagcatcttgattaaaaacaagttagctatcaagccctaattcattttagggagacagggtgaattcattatactaagacttggggagcatttcttgcaaaataaagctatattattcactcagaaaaaaacatagagcctggtgctgcggtacatcatttttctatttttcctctgtcacttattaagttatgattctgtatgtacacagtaccttgatttgtttaagttacatggattctgtgctgctttgtaaatttcaagtctgcattatgcatgttttaatgaagaatgaactatgagtcccagggacagctctggttcagtcttgtcgcacttccagatgtgcacctggttctttattatgtctcacataggaagctggtaggtatctttctgagagcatcttgttaatgaatcaatttacagtaagatgtatatttaggggaaagaaagtagaattgtaattatggtaatggggcaaaacagcttaaaaatggaaaataaaccaggagtctagctgctgaaatgtgaacattgtgtttctctttaatttgctgttgtcttggaacctagctgtttatgcagtgctttcaccttctgttgcttgtctaagtgccaacttctttcccaaaggtgttcagtgactaatgctttggttacaagccagaatattttataaatgtctatttctgggcagctcttctacaagtcttaattaaactttaatgtcaagctgaagtttacttttagaacctcttaggttgctttagtcctaacatgattatagagtttggggtgggggggcaggatgtgggacagccatgttcccacacacttcctctctcccatttaacagtgccaccaagcagattcatactacttaaccccaaggtttacaacacaggcacgagtaaatcacagccattccctaaaatgttgtggtagcacactgtcactcagactcctccaccctgcagtgatacccagggtttggaattactgctttgttagttattacacattcttccagcatatccaactgctcaaatcagggatcccaatgtagagatgatgcatgtggaagtagcattctttcctttcttctccatgtctggaggagttatgaggactgggggatcattttctctaattctcatatggcttattggggtaaagaactgcatcctatgccatctgaaataatgaagcttctattatagtcagaatagtacaaaatagatttcaattaaatatggtaatatgttatatgtttattttgtaattaatttactcatcaattggattgctctgtagcaagagcctgcatttttttctgtgaagggacagatagtacatatttgagtttttgtgggacagagatctctgtcccaactactcaactctgtcactgcagtgcaaaagcatgtctgtgttctcatagagctttatttactaaagtaggcagacatgtgaatttggccttcagggagtagtttacagacctctactctatgatatgcttgctttttatatggaaattctaaagtatatatatttttattaattaaaaatagtgcctgatagtatattttgttttttaaacatagtttgtcaatataacttaggctggttgtgaaagtaagccaagattcaaagatttttaagaaattaatcctcagttaaaaaattataagaatctctcctagatagaaacaaagatagatataaatatgtatctagcctacagaattacgtgtgtatgttgaccaaaaaactataatagttccaaaaatggaaattgtcaaaagtcccatggataattgaaaggataaataagatgtggcatattcataaaatggactatatacaccaatgataagaaacattttacaactacatgtaccaatatgttaatctcacaaacaaaattttgaataaaagccatgcaaaagaacagatactcaaagattacattacatttatataaaatacaaaaccgaacaaaaccaagttatattattaaaaatcaaggagggtgaggacaataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattagagttataaaagtggggggaaatatccaaaattattttatttgcatattccgaggttcataagaataactctcaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatttatgctgatactttcatagacttctaacagtcaataacttatccaataatttccccaatttttttctgacatgttgcttggacaccaccgaacccttctttacatttaatacagacatgtacttacctgcttatattttttgaagactgtgttgttaggctctgagaaagcatgtgaatcacgatccagcatcttctccccaaggcaaattagtctagtagtgagaggaaccagagacttgacattgtgaaaatactgcatttttatagaggtgccccgtgtgctttgagagagggagaagctgccaccttacgctgttaggggagagcaatgcagggtgaaggtggttaacagtgagttttggctggaagaacaactgagaattattgacgtccaagataaatcttgaagaataagtacacgtcagatgcatgaagaggagatgttgacatcagagtgctagtttgaaggaagacgcaaaacatcctggtgtattagatgcctgtttatagaaaaatatgactgaaacaatgaattgtgcagtgaaagtgaagcaggggccaactctggagggcctctgtgtcatgctaaggagttggaactcttatcttgaaggcaatgtatggttctcaacagacaccattatctagtttgctttcttgaaaatgaccctctggcagtgtgaagactggattaaaggagaggagaaggacttgagacagataaatcaattagaaactcaatccaagtgaatttaggttcaatcatgacattttcagacttaaaatttcttgaggcagccaatttaaccatagtagtagagaaagaacaagtatcatgtctttactacctcaggcaaaaagtggtttcccagagccctctattcacaacacttgcccgtttgtgtatcttttttacatttatttacacatctgtcctttattatatcagctctaggaaggagtgaagtgtgttggtatttgggaacgatgaacttagtgcctgatttattgtacagaaactttcaattcattcatgaatcttcaagtaataattaaaagcagaaattttgaaacatgttcttaaactctgtccttacatactctgtctttaatcaattcacaaaaacaactaaattcctactgtatctttagtatttccataaatagtttattcaaacactaatcttctctacaaatgttgatttgaatgacacaatttaaacattattgaagaaactttctaaattctgcagtgctaggtggatatttatcttttttatctatcctcacctgatattttgctttgggtaaatgcttctctacttttaactaatttttctgaatgttaaattactagatatctaagaacttctgttcttaggggaaagtttataaaatgacatactgtattggaaagttttccttagcacatagctgttctaaccctctcactgggaaaaagaatgaactgtagaaatttgcaattgtttcaagacttcagaacattctagctgtggcctttgaataagttccttatgtctcaaatacttcatatttaaaatattttaaggactttatacagtatacataacccagatcttcagtgaatggtaggtagtatggaataggatgactgaggcttaaaaatgctaaattacttccccaccagaaagaactgctggcagtgccaggacttgaactcgtgcatatatatggatttacagcaatctatactttgcaatacacaggaggatgaagcatttctccagttctgtttttaaatttggcctagttactggtggaggtgaccagctgcttcacaatttaattctagtccaacagattttagtgccacgcacttgtgggtggacatagtagttcttcctcatgccttgctcacttctaccaagtattccttctagtcttcttttctaccagttccttccattttcctccctcggttcaggcagcagctagttcaatgtctattttaggcttgcaagaaagaaaagaaaaactgctttgcctttagaaaatgttacgaaataatcaggaaaatgttaaaattatagaagcaagaggttatgcagaaaagaaatgagaaaagatacgagtttaattatagctcattaaagtttccttgggtaataggtgactgaatttataaaaaacatgacaaagagttcttcttaatatggttttacatctgcttgcatagggtcaatcccatgattgtttttccaagaaaattagtattttatgttcagcataaattatatacatatatccttgtatgcatataagagagagggatttttatttcctaaacaagaactaaataatattacttaatttttaggccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggtaagtactgtaaaccacaatagcatgatactacttggtattttacttaattttttaaaagtaaatggtagaattcacttcactgatttggggtataagtcttaatatttaggctcctagttattttcagacttactctgtgcccctgctcagaatggcaagttcttgggtcttaagtccaaaggcatcagcctcctgttttccagtactaggagtaggaggaagctgtttgggtgcctttacattctcactgccgtagccagcacacgtctgatgttggaacagtatccccttgattgtggtccttgcacaagtaacattgatcctccatcctggactccagagttatagttctttattttaaggtgacactcagacaattaatagaattttctctattctttatcaaattcgctcatcttttgtccagggaccacaccttcataccaatagtgacctttgacctctcacgaatatctgttaccttctttctctagtgtttgcgctacttgcaaaagtaacagtggaaactcagatattcacggacagtatttttaaagcattttatacttattgcaattataacctcattacacctattgagattatagctattttgattaaataccttaaacacattctcacataccagacagaagaggaccattaaaatatgaaccttatggattccttgcctcatgatttttcaaggaattcagaccctggattaaatagggaatatatcaagataaatgaaagctacaagtccagaattttttttttgtggagaatctgtttgaatactagagtacacacatatatgtatatacacacacacatacacatacacatatatatacacacacatatatacacacatatatacatacatatatatacacatacatatatacacacatgcacacatatttatatcatatgtctatttatctcaaacatataaatagaaaatagttttcctagaaaagcaaatacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaagggtaagtgtttcatatttatggcttttgttcactatcatgaatatttttttctattcttccctatctttaggttgcatagaaaatattataaatattttagcttggggtaggtagctgagtgatgaaataaaactggttcttgaaatctttgagctttgtgtttatattcttggcaatgtttgctgttttaaagggggtggcatgtttacatcgaaatgggcatgtgcatgtgtcaatcagaattctgctccccctacacacccttcccgaaaacccccacccccaccgcaggtggtcctgtctgccaggcatgttacctctgctatacaaaaaggtgtttttggcaagagtctccactcaagttgtgaaagcatttctaattttgtctagacttgcctgcgttcacattcagagacgtctttgtctctgaatgttacgtgtggatatgtgtgtactttaaaatagccacaaacccaacaacttccctgaatcttattgccaagggaggagtagctgatgcctttacaatggttcaattctacattccatagaacataaacttttaagaaaaaaattcagattataaaaaatgtacttaagattttttttaatgggctttcctggtctgtgttttacagatagatattagctttctcctggatgtgagctcactcagcagagcggaagaggacctcagtatcacagtgcatgctacctggtataatttattgttaataaaatgaactagaaatatacccccatattctgaggggggggaattaggagaaccgtaaaactgtgttccattaattgtaagagaaaacttctcttacgtggtatgcttttaaaagaaccaaacaacatagttaaatgggagttactggcaatgttttagctcttgagctatgttaagtatttattagattagattagagtagacatgatgtgtcacgaatcaaactgtgtatttgaaatcaaaaacagaataaacagtttacaagtaataactctacaagatttaaaagtgagggtaatgacttccatagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaatacttcttcaacctaaagagagtaatagatttgtttctaaactacctatttattctggtttttgtaccacctagaacataaatgttaaaaaatcttttaatctaataaatgtaactatttgttaaaaaaaaaaaaattcctctatctagcattagaagcaaatgataacagtttaaataatgagagaaattttctgccaaccttgtcctaaaaaatttttactaccatatctacttttatccccactcctcaaaaagcatttaagcaaacctctgagtatattaggtatacagggtatgtaattagttctctctgaagatttttctgcttggtgaattctaacagggtgttttctgtttgtatagtgaaaatgaagaggaaatggacaatctaaagcacagcagagtgactgtagcaatacctttaaaatatgaggttaagctgactgttcatgggtaagtagacataaaggcttcctttcaaatttagagctgatttacagtttccttgcttcttacattaatgaaaaaactgtattctagaatttttttaaaataaaaaggatactctatcttttaataattacctcattgttatagtcccttacttagctgtccattataataatccactctataatcatcactgatactacatcaaactagtacccagctggaggagatttcttactgtgagagccccaacaagctagcaaggccacactgagcctttcagctgtgcactgtgtaatcctaatctggaattaggcagtatgcagtctgcataatcatacttaatgcccatgtcaagtgtgaagttcagagaagtgtgaacttagtcaaatcactattctgcagacccgtatctacacatgtggcaaatggattgagatgtgagagatctggctgcaaggtgtcccttgtccactttttatacctatgggatcaccagattcctcaaccacagtatcagaattcattgcttcctcatgattttaatgattgagtggatccccctctcattcaagaaggagatgtgtggagaaagaataaaagggggcttacggaaaccttcagtaattccactagaacttattcatggtgttagtccttaaaactacatttttatgcagtagaagatatgagttacagaacaaatagacagatgagcctttcctgttgctctaaatctaaaccatcccgcagtcatcttatccacttagaaaggtgatatacagtcatgtaaatgtaaaatgtcagtgtctgatggaattgagtatcaagtttgagataaagcaaacgggtgaaaaaaggccattcacaggagagtaagacctagagaatcacgagtaagcaaataaaaagttcattgcgtgtttcctggttttcagtgtttatcttgccactcctcctggcttatgatgagtgtcttcctatttttctgttattcacatctcattattttgaacaaggtatgttcacctgttaaactgcctaaatctatgctggttactttcctgtttcatgagtttctaatttggtattacctaatattagctgccaaatgtgagcaccttatggagtagagatctccctagaaacatatttcttagagtttattgcagataaaaatgtcaaatcacaggcctttaaaagagagtgacagccttgtattgtaacaaaaaatttatcatacttaataatgttagacttgttccccagatttggggttcattataagtagccagcagggatcatgagatgggaagaaataattcaaaaatgggtaacataaattgaggtatgagaaccttaggaaaaaactaagaagttatcccacattacatttgccaaatttacatgaatcacttaagggctgaaagagaaggaatggtcagtagaatgaaaaaggtgtagtgtcatggaaagcaagaaaagaatatcggtgagggacagatattgtcacccaggtcagagcacatggccttttttttttttttttttttttttttttttttaagagtctcgctctattgcccatgctggagggcagcggtgtgacctcagctcactgcaacctctgcttctcgggttcaagcgattctcctgcctcagcctcccgagtagctggtactacaggcacacgccaccacgcccagctaatttttttttgtatttttagtagagattgggtttcaccacgttggccaggctgccctcaaactcctgacctcaggtgatgcgccctcctcggcctcccaaattgctgggattacaggcatgagccactgctcccggccctaatttaatttctttttaaataaaatgtatatctgaccacaaaaccaaaagtattccatggtgacttgtaaatatgctataatccagactatagaaaaagactctttataatacgtcatcgaataagacagttaattaaatttgaatttgtttttaccaggtttgtaaacccaacttcatttgtgtatggatcaaatgatgaaaatgagcctgaaacgtgcatggtggagaaaatgaacttaactttccatgtaagaaaagttaattgtgttaatatttgtaacaacctaaaaggatgtcactgatgcattgctccaagggacattgtacacctatgacgtccttcagcctctgcagaccacagctggctggaatggggcagcagcagtggtactcctgcctctcagacccctgctgctttccttccacttgtcttgtccctgatattcaagcccatatttccttacaggacaggtgagaaagagcatgcaggaacagagataatgcctgaaacaggcaaagttatgggatgagctgaatttgctagagacacatacagaaaacaggacaggccaagggaaggcatctttgggtgcaaatcagtgaaatttcttcttggttcaagcgtataaaaacctcagcactacaaagtaaaggaggctcttacctcccatctccatttaagatcacgttggttagcctttcaagccataagtttatgacctgtgacaagtgctttatcaattattaaataaccttttaaagtaaagagtactatcgtaattcagaagtattaggagactgatgtaaacctaagtttttaaaaacattttttgctgtcaaactgatatttttattgtatcaaagatgttggtgattagtaaatataatttccaaaaaaaaattctttgaaccaaaagcactgtccaagcattcttatagaataatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccaatgggagtttgtgctttgataaactaaaacagaaaccaaaccggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacatttcctgctgcaactgccctgtgcttttatggattagcaattaccacctgttcccaatttggagacactttcttcatctatgtcacatgcattcataaaatgactgcaggtctgcaagtcatcttttttaatcgaggtattgggatgcatctctttctgacttactgtattggttttacagttaagctgccagttcagtaggctatattttggccccatttcccttttcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatccccttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttatgtctcctaagactgtttctccaataaaccatcagcctgtactttttgttttcaacaataccaaaactagaaggttagaaacaatgactcatttgaaattattagcaaactttaaaaattctgactatggatatcctgtctccctttgttatgcagctgccaaccataaacctccaccactataaatgttgcatggaatatacgggatcacctaaaagctcactgatatctgtacttacatttatagaaaacatttaatttgttaaaaaatttttccttcttatcaggttatcaacactggcaatagtatggctcccaatgttagtgtggaaataatggtaccaaattcttttagcccccaaactgataagctgttcaacattttggatgtccaggtaaaaatgtatttcttccatctaacctttattgtgtgtcttaaatactaaaataaatgcaaaccaatcctttattcgagtaatgatgtgaaaatggataattgttaacttacttcagtcacactctaagctatgaattcaccatgcatttattgagttatgctttgaatattatacatttctttagaactatagagttacagtgcaacttttacatttgatttaaataacagaactatattctaccatctccattgaataattattttaagatacattgttgtgtgatatggacctatagaggtaacttctattagtagaattcttcataaaacttgaaactactgtgcaaatatgaggattatagcctttttttaaggaagcactattcaaaccacttcttaagaaccgatattcttgcactgatggttccatcagaattgttttgagcttaacaggttgaagacaaaagtcaacaaatctactaaataggtttgaggtctgatttttaaaaatcctatttaaattccagatttagagagaagaatatggtgttatattgtttcgcctataaaggcaaagaaatatttaatgtcatgctaatgttccaatatcatttttcacatttctgcaaggttaaggccattttatcagcttagaacctatatccaacctgctgtaatttggctgggtttttgtgtttctgccacagacatttaatcactcccaaatctgtcaaaaaaatttctacaatttcagaggtacttgatatattttagcaaagataagctactggaacttttaaaaccaggttgctttttgctgttttttccagtgttgaaagataagatttctcttgctttctgtcttcatagactactactggagaatgccactttgaaaattatcaaagagtgtgtgcattagagcagcaaaagagtgcaatgcagaccttgaaaggcatagtccggttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagttgagatagacccagggtctatcccatatataaacatgttggccgggtgtgatggctcacgcctgtaatcccagcactttgggaggccgaggtgggcagatcacaaggtcaggagttcgagaccagcctggccaacagagtgaaaccccgtctctactaaaaatacaaaaattagacaggtgcctgtaatcccagctactcaggaggctgaggcaggagaattgcttgaatccgggaggtggaggttgcagtgagccgagatcacgccactgcactccagcctgggtgacagagcaagactccatctcaaaaagaaaaaaaaaaatgttatacagtttcatttttttatctaacaaatgcccactatttgccaacaagacattgttccagacccttcaggacaccaagaggttgtcttcacctgggcagcctttgtggcatgggttaattttcattcttttcagcttagtgaatgtatgaaaagaaactggagaagcattcatcaccttgaaatgatccacgttttacaacaaacaaagaatacgtaacttagcaagactctgattaggaacattttttaaaaattctgtcccagaagattatgttaatacaaataataagaacatatgctgcagtttaaatactttattataatttagaaaacaaacattcatgtcttgtttaaaggtaatttaaatgccactaaggaaagcagatgtttaatttcatatttatggaaagatgattttcaaaatgccattagagtatatattaaattctatataaaatattttaaaaatattttccaatgttgaaaattttaatgtagcacttttatattcccttcaagtactgcataaaagctgatccacattgtttaaatttcttgtgtaattttgggaaaatggaaagtggaaaagaagccagtgttcatatccaactggaaggccggccatccattttagaaatggtaagtaagtctaaaacattgacaacttggtggctaagtttacataaaatctataaattcagtcatataggcaggatagtatgaaggcattcaacaaattaaattttaaataaaattttggagtaaaactctaaaactgtatttctatcacttcaactatctacattgactaagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatctgttttggttagccttgtagtacagtttgaagtcgggtagcctgatgcctccagctttctttttgcttaggattgtcttgactatatgggctcttttatggttccataggaaatttaaagtagttttttctaattctgtgaagaaagtcaatggtagcttgatgggagtagccttgaatctgtaaattactttgggcagtatggccattttcacgatattgattcttcctatccatgagcatagaatatttttttccatttgtttgtgtcctcttatttccttgagcagtggtttgtagtgctccttgaagaggtccttcacatcccttgtaagttggattcctaggtattttattctgtttgtagtgaatgggaattcactcatgatttggctctctgcttgtctattattgtatacgaatgcttgtgacttttgcacattgatttttgtatcctgagactttgctgaagttgcttataagcttaaggagttttggggctgagaccatggagttttctaaatatacaatcatgtcacctgcaaacaatttgacttcctctcttcctatttgaataccctttgttgctttctcttgcctgattgccctggccagaacttccaatactgtgttgaataggagtggtgagagagggcatccttgtcttgtgacggttttcaaagggaatgcttccagtttttgcccattcagtatgatattggctatgggtttgtcataaatagctcttattgagatatgttccatcaacacctagtttattgagagtttttagcatgaagggatgatgaattttattgaagcccttttattttaaaaatatagctaagaagaaaaactaaggctttcataaaatcaaataaaatcaaaattcaacaacaaaaacatatttaaattttaaaaataatgaaatatatcttggactttttcctacaaaggagcatgtatatttatgaggagtagtttgagatgaaactagttttatgtggagttctgtttttcagctttctcatctgttcaatatggataaatgagatgatttttataagcacttagttcatggaacataggaagccaaaggaaatggcagctgttatgttcaagtggaattcttgaaattgccaaacagtgcttaagaggaagatacactagacaggcaaagaagaaatatccattttagtttcaactgtgctaaaagcaaagtcattgaaccatcagcaagtcatttaaccttttgcagtttgccttatctttttctctaggtctaggttttccatcagtggccataattggcattttgaaccagataattttgttttggggggttgtcctgtgcattgtaggatatttagtatcatcctcagcctctatacgctcactgctggtagtaccacctcccacgttctgacacttgacagtttctttagacattcctgactgtcccttaggtgataaaaccctccctgctgagaaccactgctctagatctataggaagcttgtcatttttggctctaaaatgttaaataacatttacacaatagttttaaaggtcatatccctctttaagaatctgactaaatatattctcatctccctcagcaaatgcacacatgaaaacatctcctaaagattcttagaatttataaagcccttctacagatccccaagcttcatggattctgcgttataaaatccttgctttagatagtaaagttctgagttcatccactgattttatatttgaattctataatgtatttaatttagaaagaaataaaaagcccaaataagatagattcaatatgcggtggtggggtggagaacaatggtaaatggtaacttacctctttctgtagtctaatatttaaatcaagttatttgcaaggtagctgtttaatcaaaggatttcaataaaatgatactatataaattaataccaagaccacactttgggaaccaaaggaggcactgcagttaattttaagtggtgaaataaattggggaaggtaaattgtgaaaacctctagctagaaggtaaagatcctgataaattatgtctttatgaaataaaccaggctatggtgatccttcttttattaaacaggatgagacttcagcactcaagtttgaaataagagcaacaggttttccagagccaaatccaagagtaattgaactaaacaaggatgagaatgttgcgcatgtaagattaccctcttaactgctacattaaaattataggaaaacacatttcaagggtgtctataattacttccttctgagtaactgagttgggaaagtagagtgtgaccagctcatggagggcccccaatacttggttgagagttggcattttccacaactggcaggagggaacaatacagcagttctttcagagaggtgaattgggcagcagtgagaattgaatagattggaggaaaagtcatggatacagcccattacactcactgtttctgctaaacagttaccagtgtttcctgcaattatattagaaccagcaagaaaatgggctgggcagttctaaatactactggggattatggcagggctttaaaggaaatataagcaacgttttaaactgatttttttttttggtttttgagttttatttttcttaactcacgtaggttctactggaaggactacatcatcaaagacccaaacgttatttcaccatagtgattatttcaagtagcttgctacttggacttattgtacttctattgatctcatatgttatgtggaaggtaagcatttaacaattaccaacattagtctactaaaaatgacattttctcaaagccaatttgacttccaagttattagatttaaatatttcactatttgaatgttaactttttatgttgctcagtactgatctcacatttctcttcaacaccaaagtctttctagaaaaatatgcattcttaatttgttttgaaagacagacgttccttttaaaaaaccatttggaaaagattgcaaattacacggaatgtcaattttggagagaatgtggtgtgtatcactgagaatttctgcattaaaaacaaaaatgtttctttaacccagtatgtccccactaatttttactgattacctctgttaaacctttatgactgatgttacaagggatgcagtttaagaaatattggtgttaactgcttagatattagaaatgagtatagtagataagagagtgttcataactatacactagtgattatgttatgctattttcaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatctgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctgtaaagaaaatacattatttcatcaacttattttgttgtttttcacatacacctaataagtatggtacacaatgccaatgccaaatacaaattgataacaaacacagcattcccaacagagctgtaatctagaaaactgagaaggtctgattgataaatcatcaacaacaataattgctctaaaacctccttaactgacttccttgattgtccaatgctctccattacctctgtaaaacagtcagttatgcctctagaacacccatgtctagtgggcacccctgcatgcttcttctaaccactgagtgtcacaatgcctaccaagaatgcgtttgcaggttcctaaacctgtttataccagttgctatgtaaaattgttcccaagggaagttgaatgctctgtaaaggcctaataaaagcaaattactgaacaaaacatgttacagtaattatgagtgagaggaaactaagatggaaggataaaaatctaacactttactattcagatggctccactaaaagatttaagatcttgatccatttttaaaaatccaaaatggaagttgtagacattatctgtagtttatgcacaacaataaattagaaagccaatgtagacacgcataaccaaagaaaatgccttgggtctacataacagttgaataaatgtaaagttgctttttatttattgaaatttgtgcatgtctctttatgcttccctgatttactgattttttaaaaactaaccaactgcctgctttgatagttcagagaagagagctttcgttgtaatattagatttatgtttactggttgacaataagcggtgaaataaatagacttacctaatatggacctctgatgcaacttccattaagtcaccatctacattccaagggaaacaattttctgaagcagtttcatcctcctcctcctctggattatatccaccagtattattccttggatgaacttttacttcctcaacagtgtaagtctcaacaaatggaaaattgaactaaaaataaatacaaataatcattatacttggtttatctctagctactaacgcgaatcaaagttcactgagccctctctcacaagtaaatatcagcatgtatgctgacattttaatagctttgagactatgaacagggatctccaactttttttggaagaaggaatctcttatccaaagccttttgggttcttttagatctagcacctagaaatcttgttttatgacaaatagtacatatctgtgagaagttacataaaatagtgatactgtagatttttcaattaaagataatctttaatactggcctgtagatacagaagacatataatccattatcaacttgtcaattagtttagctgacataaagcaaactagtacaagtttcacacttggaatttaatttggaagaacgcaagtctaaacttctgaagataaaatgggatgtatgtcttcttttaaaagagaaagccaatcaaatatggattttaaaaggtgtttgcctgccccattcccactttaacaatggacacaagctgcaagatcactgtttacttaccactatagaatggtgcaaggtaaacttcaacttgcgttttttcttgtttgcctaaggaaactatactgaaaaagcactatgtattttctgacataattaagaaaatatagccaaataacttgagcagaaatgtataactactcatttcagttttcagaaaaatgacatgagatacattcctaattaaacatcatctacatagtttttccccttttccacatgtaaacctcaatgaaacagttttaaaagttgacagaaaactaatattttccccaacacccatattttacatatgtagataccaaggtccagccaactttccagtttatactgtaaacacagttaaacagtagatgatatgatggcatcagctgttgtgactgaggtacagaattagagggccccaagcaaaactgtttgacagtaactgcgttagacctcctacctcgggtataaagccttggctacatgcctcatccttgtagaattatctacataatcattcatgttagttgataattcatttaaaacacacaactgcctgttatgatctaaattatatttccctccaccaccccaactatgttcaagtcctaacccctggtacctgtgaatgtcccctgtttagaaatagggtctttgcaggtagaatcaacttaagatgaagtcattagggcgggacctaatccaatatgactgatgtccttatgagagaagaatgccaaggatggcagagtcagagactggagggatgcagctgtaagccaaggaatgtcaagaattgacagccaccaccagtaagtctattatcttaaatcagcagttgtcatgtgcactcctcacaaaatgaagatctagccatccttcaaatgctttaactgtgaagccacagacgctgttaagtgggactttcgggagccaagagcttagtatcctgtgtgagggtatgtttggggcacggggaggagaagtaaacagttacaattttgatacaggggagtgccatgatggtgcaagtgtggagttcaacagaggaaacaagaggaggcaaacaggctatggatgttgggaaagcttcccatttgaattgagccttaaagaacatataagatttagcctggagaagaaagtctggagagaggaagcatttacaaaactagaggcaaaccatggtcaagcaactacacagaattcagtgtgactcctaggtgctcaacatcatgccccttggccctcaaattcctgtattgaaatcctcgctctgtatacctcagaacataactatatttggagataagatctttaaagagacgattaagctaaaatgatgtctttaggccctcatccaatacgactggtgtccttataagaagaggaaatttggacataggaaaaggcatcggggatgaacagaggaaagaccactcacttgtgggtgctgtgagaaagcagccatgtgccagccagagagagaagactcaggacaaaccaaacctgctgacattgtcttgcagctctagcctccagaaccatgaaagaaatacatttctgtttgtttaagccatcttttctgtggtatttgttatggcaaccttagccaacgaataaaatgccaaaacactgggaatgtggtggagggtggtaataagaggtggggttgcaacacaggcagggacctggatacaaaggccacgtgttccagactgaggatattccatattattctgacaacaagagaaaggcactgaagaattaagcaggagagaaatccaatgtgtgtcttagaaaaaagtttctctaaaaagaggtatggaagacaagaccagagaacctgaaggccaaaaggaggctactgtaagcaagaaaggattaaagtttgaattaaggtgagggagaaattttagaaacatttaagaggagaccaacagaacaagttaggggactggtagtgaggaatgaggaagaaggaacagttcagggtaacctggatgggtagaaagtggtgccattgacccgcacagagcaacgcagaaggaacaactttaggggaaaagataaggtcggctgtagacatgttggcctccagatgccggtgaatttcagaacctcttcagcatacaagaagacagaggtcctgcagataagacgagatgacagaacccttgggagtgcatgatgttcagacagttcaaaagtgaggggcaatgaggccatccaggagacggcatcctgagaagatgagagggctgcaaagaaatcctgggggaagcactcacatttaaggttttaaactccctaccaaaaatggtcacaatgaaagagaaaagtgtggacagtgagaaggggggcaaagcaataggatggagctgcaaggactttgaagggtagtgttcagcctctatctaattttacacagagatggggaaggaacaggagccactccgcacatggtggtttcaatctattttacagtgttatacagtaacattcgcttattcaacctggtaaaaatggttcagagaagcagatgttactctccttaaactgaattgccacattttccttcctgaataccagcactgctatgaattatgcagtagacatgatttttacatagatctgattttcataatcttacaaaatttatataaattcacatttttaatgtcaccatgaaggaaagagcctaaataaacacacctgtgtggataattaacaaatcaaattaacattgcttgaaagcagtcaccctgggaatcaatctttcttactatatacactatgcaaaatattttagaattctttgcaaaaaaaaaaaaaatagcatggattttaatttttgaaagttgataaataaatcagagttaaggccagtgaatcacacacaggcaactgtttcttgtgtcaaaagcaagatatgcctcgtagagtacatgagaaaatatgataaatcctgcataatattatctcttagaaaacgtcttcctatcgatacagatttttattattttctgtatgtctgtctttatgtgtaaggtaaccattgcttttaaaatcagaagaaaggtatattgatttaaaaaaatgaagaagaagaatgtttacaaaaattgcctgagagacttgccccataggcaatttcaaaagagaccttccataaacaatttgtgcaacatacacctccccaaaataaatacagaacttctcaggggtacattaataggttaatactatttaagttctcaaatagaggtacatgaatgaggttaatacttactttacttctcatttatttaataaaaaaggattcggaaaaaattctaccaaggtaatgacactaatcttgaggaacatggaattttgagtgctttaaaatcattttcttgtttctattttctgacttaaaaacagcaatgaatatatagtgctttgggttttttaaaaattggttttaatgtttagaaatttattaaaatgtgaaagggcatatattcctttgaaaatcaataaatctccatattccacccaaacacatacataaaactgttatgtaggctcacaacctacattatacctgctgatctactttgacatataaagaaagtgggactgtaattttttatgatttaagttcctaagcagcccagttagttgttcaatacatgaggatcaaataatgttactgacagatcaaacttcatgaagatggcctaagaaagttttaaaatataatgaggcaaaaatggagagacttgctatggctaaggtacataagcaaggttcagctgccagtcattggctgggtttactctcctcctcctcccgtctgttatctcccaactctatccaagcaccattttatacctttaagaatgtgtgggccggacgtggtggctcacgcctgtaatcccagcactttgggaggccgaggtggacacatcacgaggtcaggagtttcgagaccagcctgaccaacatggtgaaaccctgtctctaccaaaaatataaaaattagctgggcatggaggtgtgagcctgtaatcccacctactcgggaggctgaggcaggagaatcgcttgaacgtgggaggtggaggttgcagtgagcagacatcacgccactgcactccagcctgggtgacacagcaaggctctaactcaaaaaaaaaaaaaaaaagaaagaaaaagaaaaagtgtgaaactatagggttttacaaccatacctatgtacttcaaagactcacaatttcagaaattcacatagttcaaggatcattttcctaataatcaggtcaaaacagctgccaaaataatatggcttgtaatagttactgtttctctttaaagcaaatcacttaagtggaaatgtatatcttcacatattctcattttgaatgaatatttgtataaaactgtcatatttttaaatacatatctacagatctatttcaatcaatgcagatatgcaaacaaatgtcaggaagatctaaagatcataactttagaaagtctgctgccataatatcaagaaggctaaactctcaaatttcacttcttttcattctgaagaacagcctgagtatggaattttatccttaatttatttcacattgcaatataacactacatttcctattttatctttgtggttacagatacataaccactaattcatcattcaaaaaaggccaatctatattaatcctggcggatgcttttcaaaatttggatgaaatagattgggaaaaagaagattaatatattcagaagaaaataaaaccttcttatgaggcaggattcgatgtcaattcttgcagcatctttttctacatgattaatagctttgcaaataagtaacaaaaagaatttactatacctgattttttacactggcatatcttttcaggtgttttataaattctggccgagaagtgtttcgggcaattataagagccatacttccattatttaatctgaaattaaatatttctattagacatcaagaaatttactaagagattataccaaaaattatgacatactgttccttataacaagtatactgtttactgaaagtattggacaagatagataaatcaccatgttacgtttacctaaaattcataaaccgtatcttgctattttttaaatgatgcaggctttcaaatgagttttattaaatcactggcttccttctcaataagctcttacattagagcattttacaaagcaaaccatcaagcgtcctactcacatatcaagacataatttaaaatacaatgtaattagaaattctaaatgtgaaactatgttgttaaaagatgtattatagaagagttaatatgcacaagttgtgtaacaaatagctcaacattttctaaaatctaaagtgtgatttaaatatttatttatagacagaaggtctaagtgacataggaaatgaaataaatcaaagtggcctttggatggatgaaatggagtgaacaaatgctgccacacatgttcagttaaatgactgaacattttaatcttgcataactgttccatccaatataagagagtgaaaattcagaggtgtgatttagtgccaaaacagccactcacaaatgcatcaagctatagaatgcagtttgcagaaatacatacaaatgacttctagcttgatttcagtgcaaacatgaagttaatttaagaataacaacaaaataaaaaaagagctcttagtatcttatgaaagctcaagtcagagctgtaagggaccttagagattatctcatcattcgctcatttcatgtagagggaaaagacaactccaagtttaagtgatttgttcaaaggcacacagagaaaaaatggtcatcagcaccaatactccaggtgctcagtatgctttccatcatgcttcttcttcccaattaaaaataaacagcaccaaaacgttcatggtagtgttactgtgcatctttaattgcataatttataaacattaaaagcactatcctatgcctgctttgcaatatttacttgaaatagaaacacaacttacatggctggcactgctttaaatgtctcacatatatgaacacatttaatcttagaatacttagaatataagaatattagttcctactggcaatttgcactgagatattctaacataaattattatttatcatggtgggggaaaaagaagaaagtgaaatctcctgttcaatcatcctgaatcatcagaagctacatctctgaaaaatctccggtcaaatgagtcttgatcaaaaggtctttgcaaagatggcatgttgtgattataaaccacagaagaaatctctaattagtcatccttctctgaaaaattcattaatactgattaagcctgcagagtcaacagtggaattctagtcaagcagaacatttatggagtggctttgaaggagctatgaatcgattgttcccagaagagcaggtctaccctcccaagaaggtccttaaacaaacagggttagataaacattgtctcaagtcctgccaaacatagctccttggtcagctagccacgtcttcaagtttagtcagggaaactacattatgaaagcacacagctatctaggatttctgaaggtgtcggggaaaaccaccaggctcaatttctaaatcacacaaggttcaaaatactcctttgaagttttagcactagatgtaattaatgaggaccttgccatctgggttttcaatatcgaagtttgcagtttctcttttttcttctctaactttgaatatttccccgtttattgcctatatttcacaacactcacgatcctttctcctacactctacaggattggattcaggaaagaaatattttcagccccataatggacagctgattaagaagaatgtgcaagagaaggaatgtctatatcccatggataaaaagatatatataagatgtctcatattttattcaattgaaaatgtgggcaggagattgatatgcactactattcacattaaatagaactgaaatgtttcttttgactaaaagtatctgatatggtttggctttgtgttcccactcaaatctcatcttgtagctctcataattcccatgtgttgtgggagagacctggtgggagataactgaatcatgggggtgggtctttcctgtgctgctctcatggtaatgaataagtctcatgagatctaatggttttaaaaataggagtttccctgcacaagctctcttgtctgccgccatgtgagatgtgactttcatcttccaccatgattgtggagcctccccagcaacgtggaactgtaagtccattaaacctctttcttttgtaaattacccagtctcgggtatgtctttatcagcagcatgaaaacagactaatacagtatcaaatatacatatgtgtgattttcatgctaaggatatttatgtttgcattaaagttggaaagcaaagacattcacaagaaatatcagtatttaatataatgttctccacaactaaatgaataaatcaagtaaagtaggcataaaattctatcaataaaacttaggaaatattattttagcctcagtgacgttaaatagtcaatgattatctgataattattccagttcaacagttgttctcaacctactgtgatgacaaatcccttagaatctctaatatacaaagataaactacctgttaagtttctagctaaccaacagttaattggataccctggaaaaaaaatggtctataagaaatgtatcaacaattcaataaaaatgcttactaacctggtattaggtgccaagcctctaggtgccactgaacacaggcaaggaattgccataatgctgacattcaagaactgaccctggatcatttgccattgatcattacagtctaaaggtaatgaaagtgatt

SEQ ID NO: 1112 - DNA, 387469 bp, Homo sapiens
agcacaggactctgagagggaggcggggcaggaaggcagtccattcttaacatacttatgtagtcacttttctgtcttgaggcacacaaaaaaaacaaggtcatatcttttaatgtctcagtaaaacagcttgagccctccccttatcaccttgagaaacgcctcaggccttcctccaaggaaagacccccaggatgcttagtcatatccaaaatgtcaatccctgtcctttccaccttgcctttgcagtcagaacctccacccaaggccagaggatgccccaatgtcatgtgcactctatctaccccactggcatcccaggcagtgtgatcagggcttagtgtcctgcttctgccacctccgcaactgctggcacagaccttttcatagttgcagcagaccctggggcatgtggagggaggacccatcttcgactccccattgcactcagcagatgtggccaccttccagtatcactgactcagacacacgcacccagcccttgcccagggtgcaagcctgccttcaggaaggatgactgcacccaggctggctgtctcagctcctggactcagaatcactattacctcctcaaccccaacttcctgcaggagctagttcacctgttttttatgtcagggaccttggggccttccctgtcactggatttgattcggagtcatcccaatctcacaacatattatttattccccccttcatgtctttgaataaaattgatgcacccagaaggtataacatgtatatcttgcagcttcaagtacaagaggtcctaggcttcaacttaaaaactttctgggggaaggcataagaaggcttttcttgtgggagcgtgttaagcagcagaaggggtcccaaaacgtgtttagtgtttacccttccctaaagacatttgcttagagtttggagtacactgaggctgcctgaaagaagacagggaagaagctagaactgcccttccatttcctgcaaaatttcatctcctgccccactcccctactcgtaactctcctttagacacactcctctatggcagacaacttctgatacattcaattccaggtactcattttttggtgaatgttccattgcatctgaatgatattgaagtgaacttctcttacctgcatgtgtgtgcacacacacacgcacacacacgcacgcacacacacacacgtgcgctcacatgcacatgcgcacacacacgcacatgcacacacgcacgcatgtgcatacacatgcacacacgcacatgtacacatacacacacacacatgcacccaaggtcaacaccttaaaatcccactgcatttaaaccatgagtgggtgggaccttgaggaaatcaccaaagatgtttcaggagtctccctctgatggcccacatctgggaagccctggagagatgtggatttgacaatttacgaaagctaaggtagagagggccctgaaaaaggagctggctagccggccgctgatgtgagagtgaggtcatgggtgcttgggttgtgactcacctctccagcccttcacagggcacctgaagcacctgggggtttgagggcttgaacacttagacaaaggaaggctctaaaatggcccactgaaacatgcagacaccttgagaaaagtgttttgagtttttcttttactccaaataaaaatagctattttaaaagagtggaataaatgacataataataatggcactaaattgctaacatgtaccagttgcttccctcatgctgcgatgtgcagagtggctcattacatttaatcctcacaacaaacctttgggtatgattccctgtaacaaatggggagagctcaaataacttctcagggccacatacctgatgctgtggactgaatgcatgtatcctccaaaattcttatgttgaagccctaacccccaattcgcctgtatttggaatatgaaagtaattgaggtcataagggtggggttctgatctgatagaattagtgtcctctctcttgctctcgctctcccctccctccgcctctctgcaagcacgaagaggtcatgtgagtccatagcaagaaggggaccatctgcaacccaaaggaagagccctcaccagacaccaactctgctgcccttgatcttggactttcagtctccagaactgtgagaaaataaatttatgttatttaagccacccagtctgtggtatttttttatggcagccctagaagactaatatatctgacaagccactacattgggattacgagcaccacagccctcactgttactcatcaccctaaactgcctccaacaaatatcatcattttaatattttatgttttgctaagccataggctagctttaatatttcaattgaagtgagaagtgtttttaaaacttggcattatgttgtacagctgtattctaacactgatggttgttgcttaaagccgtttcactaaatttagatctctggaaaaaaatttgtttgagcatggaaacaggttggaaatattgcacccaataataacagtttaacttttggcttatgaaatacttcagtgggaaagtatttgctcaaatctctgcctgctattatagttgaaggcttggcgatagtatttgcccttcctctgaactttctggatatcaaagccacgtggaagtatagcttgtcttatgtatgaaaaacagggcaaggcaacttttgaagaattgccgttaagaggtgcatttagctgtgtcaatcatttagacaacgattatctggtatgtgaatgatccaaaccctttttatttttttctgcctcttttgaaaatactgtgaggagccatctggctattgaccacttcttccttccacatgatggctggtctacctacctcagttggcaaagtcccctcaacagaggccagggccagagggcagggcttgttaatagatgggaatgagagctgcccttggctcctctttctttctctgttgtgtgaaggtcaagttgtctcctcatttggagatcagatagctgtgtgtgcacagctcttgatccacttccctatttctaactttgattagtgactttggctttacggaggtagcatcttctacatccactgctggatgtagacatccactgtgtctctgtagacaattcaagcagtactaaaggagtgatagatagacgatagatagatagatagatagatagatagatagatagatagatagataggcaagaatagcccataatctcaaccataatcattattaacatttagggtaaacttccaaatctctttctttgtgcatatatacatacagatgcatagaaatttacatataccagattatagtaggcatgtccttaaggaacttgagttattacccttgttatgctgcagggattgttccttgtcagtgtgtaaagttgcatgccaaccttttgtaacaggctgtgtaaggtgctgattcaaccaaatagtggatagtataggctggattgtgcattgttaagaaccaagtggctaagttctttagggctaactccaaagaaaacccgacagttggcattagatgccatgtgccccaagaatgagagaggatgaactgactttatgggccttgctcttttggagggattagaactacagagatcacttttggggggagtgcagtgttcatgggctggttatgtaataaacggtatattatcttgtaatatatggggtgtgatgctgtcttctcttctaaactgaaaaaacttgattgcagaaacacatttggccctaagagttttggacaaggattgtgaacccatcatatggtcagtcctcatttcacatggttctatggtaactgagataaaatctcagactgcatcttcccaactggatcactgtgaggtttacataagataaagtgatctataacatgcttagtgcagtgtgagacacatagtgagtgagccttccttgctgctagcagtcctatcaccttacagcagcatctgctctgctcgagtgtctgtacccgtcaggtctctgcaaaccgggctctcataatcagtggggagtgtctaaacctccatttagggtcctcctacggtacactcacacagaccccagaaatgcaagcagtcccttgggggagacaaggaggatgttagagagttatggttgggaagctttgtcagggagaaattagcatttcccatcggagaccatgggaagggcactctagaaaaaagagcacaggaaaaagtatggctcaatacagggtccagaaatactcacctggaggaactatgtgtatttcctgctatagtaatatagcatagtatttgtaatgaaaaattgtattctaaacctaaagattactaagccaattggcttgtattaagagccttagatatctacctagctttgacctagtagttaagcatttaggaaataatgagaggcagataaaaatctacaaatgtataagcaaaaagaaaaaaaaagatattagagaaaggaaggattaaaaagactaattaatcttaagagtttttcctttttcttttctttctagagacaaggtctcactgtgtcatccaggctagagcatagtggtggaatcatagctcactgtagcctccatctcctgggctcaagtgatcctcccatctcagcctcccaagaagttaggactacaggtgcataccaccatgtccggtcacttttttcgccctagagatgaggtctcactatgttgtctcaaactctggcctcaagcaatcttcccatcttggctttccagaagttgggattacaggcatgagcaactgtgtctggcctccaagacttttttgaggcttctgaaaagccaatgttgttttcaccccaacatttaatcattccaatattcctctctgcagtgaggcaggagggagcagagcagtataaccatcacttcttttgcattgttacagtagcagtaacaattcaacaaagtatgtatgtaactgtttaattgtttaacaatgtaactgtttaacaaagtaactgtggagagcaattttgcacagcttatagaaaacgccaatgctaggtgagctgatagagcatgctgttcagtttgcagccactaaggctaatggaaaaccttcagattccttcttgaagtgagagcataaaggaatggagggcatttggttgccatttccgttgggaaattggacaagaggttcagtttttcaaaagtctccattccataaagcaaatctacattttgcatggccaggtttgaaatagtatgcctctcccctccagctggtgaccctggagacacgcccttcaggtcaagtctctgtaaaacagcttattctggcaactaggaaattgagctcactcttgagctcagattatacgaataactaatacatgtttagcgttttatggttaggaaatgctgtcctgagaagctcatcaataggtttattagttattggtatccttgttttattgatttactaaaattacacagttgttcgggcctgggagttaaattctcttcaccagatgccaaatcctacgtttttcttaccacatcatggtgccacaggttaaggaatacagtgcagggttctgaatctctctcctgtaggacagtgcttcccaagcctggctacttgacaaatctcccaagaggtgttggaaatgcagattcctgggccttgcccctagattctgacctagagtgttattagtaaatctgtatttttaaatagttgcctggtggtctaatatacagtcaggattgacagctactgtttagttaaatcaaacaccaatgctataatttttaaccgatatcatttttagggtttggtttccaaagttggaaatcagtgtgttttagatcagtggtttcctgtcttctaaaacctaccttacctttaaagaatctgttgaaatctgtggatctttccctaagaaacacacaaacacacacatacacacttttatatataattctagagggctatattagtttcctgcttctgctataacaaatggtcacaagcatagcggcttaaaacaacaacatttattatcttacagttctggatgtcagaagtgggacaggagtctcactggattaaactcaaggtgttgcctttctggaggctctaggagataatccattttattgtctcttccatcttctagaagctgcctgtattacttggctcatgggtcccttcttttatctccaaagccaacaatgtggcatctctctgaccccacttccacttcacatctctttctcgtgctacagccaaggaaaggttctctgcttttaaggattcacataattagactgtgcccagccagataatcctggaaaatctttccatctcaagacccttaaccttaatcacattttcagtccttttttgccatataaggtgacatattcacaggttccagggattaggagggggactattagtctaccaaccacaggggatcttaggacctctgaagcaacatggaaaatgagtgaactctaggttaggagcatctgttctagattccattcattctagatgttaaatcaacaagaaattctgcttgcctacaaataacagaatccctaaaagcagtggctcttataaattaggtgtttactttttttcaggtagtaagaagtccccaggaaggcatcccatgtcaggtgcagcagttctagcatgtgacagctgaagtctctgcaattctcctggcctttcctttgaggtggccctcaaaacagctgctgcatctccagccatgacctctgtgcttcatgcaagaggggcaagggcacaggacaaaagccataagtcagctgagttgcctctcctttaagaaacctcctgagaagcctaccacccaaataacatgctcatatctcattggccagacactgcacatggccactctgtctgcaaaagagactgggaaacatagttttatttatttttaaagctaggcatattaacactccactaactctgggctttgttagtaaggaaaatgggaagtataaatattgggaagatactagtgctctctaccacagatgaaaacttcagccaggcacagtggctcatggctgtaatcccagcactttgggaggccaaggcaggtggatcacttgagctcaggagtttgacaccagcctagacaacatggcaaaacctcgtttctaccaaaagtataaaaattagccgggcatggtggtacatgtctgtggtcccagctacttgggaggctgaggtgggaggattgctggagcctgggaggtcgaggctgcagtgaacagtgattgcaccactgcactccaacctgggggacaggagcgagacactgtctcaaaaacaacaacaaaaccaaaaaaagaaaaacaaaagaaaaccttgtgttttgtgttctacaacgagaattgatcatttttcactctcacacaaccaaaacatgaagaaagttaaaagtctccttcaaaatctcccccatagtgcctcatcctcttactaagcttgcttttctttaagcaggtcattctttttttttttcatttttcttgagatggattcttactctgtcacccaggctggagtgcagtggcacgatctcggctcactgtaacctccgcctcacaggtaaaagcagttctcctgcctcaacctcccaagtagctgagataacaggcgtgcggcatctcgtctggctaatcttcttatttttaatagagatggggtttcaccatgttgaccatggttggccaggctggtctcgaactcctgacctcaggtgatctgcccgctttggcctcccaaagtgctgggattaaaggcatgagccaccgtgcccagctattctttttctttcttttcttttttttttttttttcagatggagtcttgctcagtcacccaggttggaatgcagtggcgcactgtcggctcactgcaagctcgacccctcagcttcaagcgattctcctgcctcagcctcccaagtagctggaattacaggcatgtgccaccatgcttggctaattttttgtatttttagtagaaacaaggtttcactgtgttggccaggctggtcttgaactcctgacctcaatccacccacctcagcctccccaaagtgctgtgattacaggagtgagccactgcgcccagccagttcattctttcaacaatgtttaagcatctacctaagcctggcactgagctgggccttgggggctacaaagatatctaagacttttttctccttagagagctataccgtctatggagagggacagagagcccccaaaatgatgaacatgttctaagtgttgagatagaggcatgtgaacactctttggcagcccagaaaagaaaggggaagaggaaatggcacagaaagggtgaggcaagaactggcctggaagtctaggatggataggattttgccagttgaagaggggtaggcacatttcaggaagaaagaacagcgttggagaaggcacagatgtgtgtgaaaacccctgttggacacgttcaggggacagctagaagttgtgtgtggatacattgtagggtttgtgggaagtgagtcaggaaaggggcataaaatggggctggaaagagagatggagcctccatgtgaagttatgctaaggagatcgggctccatcctataggcaggagtaggtggtggggggcaacgggaagttttcaaccattatccaaactctgttgtagaattaaaaagtggaaagaagagaacacaggcagggaaaccataatagtgtggtcagacttcaacatgatagcagtcaattcagtaggaatcttgaatttgagtagtcaagttcatagagacagaaggtaggaaggtggttgccagaggctgggggtggggatgggggtagggttagggggaaagaggagttattgtttagggtataaagtttgttttccaagatgaagagttgtggagatggatggtggtgaaggttgcataacatgcatatacttaatcccccgaactgcacagttacaaatggttaagatggtaaactttctgttatgcatatttacaattacacacacacacacacacacacccttcagtgcacgcaaaccctgctggactccaaccttcagagcttccgatttagcagggctgagtgggacctgaggatttgcattttctgacaagttcccagatgacgttgatgctgctggtccggagaccacacttcgggaatcactggtgtacgagaccaagtgactagaatatggaggggtgctctgctcgcttccacgtggctactattgttatgaacaacaacagccggcgtttactgagcactgctcctacagcttatctcacaactgggtgaaggagcagaggatgcgcagggctagaacctggagtctaaactcgtccttcacccgggttgctctggatcttactggttgtgagacagggagggaaagagagacaaaggcagggagacaggcccagcagggccggcagagcctgtagtgacggaggggagcagccttatctccgggaacccgagcgccccgtgcgcggcggggagggggcagttcggggcgccccggcgggtcccaggggctgactcccgcccgggaagtgcgcgcagggctcacggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccccccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacacagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcgaggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctacttggatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttccctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacatgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggcggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagtgttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgacaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcatttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccccagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacagtgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccacccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgtacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtgtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcaggccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattactggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtcagaggtggctatcctggcaccagctcttcctttactcaagcctgggctgctttctgcccagtaagggatgcggacaattcctggggtttccccgtggtggacacacagtgaagaatttgactcatgtaaccaaaacgtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggctggaatggagccttcacagacagcttgaccacacacagggagctcaggaagcagctttgttggaaaaatgcagggcacttaaactgccacaccaggagggggtttggagaggctggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcgtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctatgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtggtacccagctactagggaggctgagacaagagaattgcttgaacccgggaggtggaggttgcagtgagcggagatcgccgcactgcactccagcctgggtaacagagcaagacaccatctcaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagactcactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttagaacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggccttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctgtttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatacagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccatcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttattctgtgtgtgagtggggaggccactgaaatcaattttgggtattacattttaactagggaaagatatgatcagatggatgtttttaaaagctcactttgcgctgggcatggtggctcatgactgtaatcccatcactttgggaggctgaggtgggcacattgcttgagcccagaagttcaagaccagcctgtgcaacatggtgaaagcctatctctactaaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgtttgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgtgagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccatctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagaacatcactcctcaacccaagtctggctcttctcctctttctccagggaagaatcggggcacgtcctgcggaaagacctgccgggaagaccgcgatgatgagtggatgggggtgagcctggcccgacagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatcgtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtacgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaagaacccctgcaccctttcccagtcagttcctctgcccttggtgagtgaacaactattctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattcctccaggcatggtggcctgaccctgactggacaaatgggccccagaggggctgaacccttgtctgccattctggggaaagaaagggaagaagctgactcatctgtaaatcaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactagagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgtttttctaattgtggccaaacacatgacataaaacttaccaccttaaccattttgagtgtacagtagtggtaaatgtatggcacattgttgtacaacaaacctttaaactttatcttgcaaaacttacatccattgaacaacactctcctttttctccttcccgtggttcctggcaacattgtatttctattaagagtttgactactttagatcttatgtgagtggagtgtggtgttcgtccttttgtgacgaacttacttcatttagcataatgtcctcaaggttcatcatgttgtagcatgtgaccggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagaaatgtttaggtcctttgcccaattttaaattggattgtttggtttttattgttgttgagttatcctcatggcattttgcacatgggcagtcttgctaggaaaggcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagatacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccatggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagtgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggacaaggccctccttcccctttcttatgattagttgaaatctgagtttgagcaagtcttgctgttttcagagaatgctctccttctcctgttcttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgaagccaagggctttgctaagtccaaaaacttagcaaaaccaaaacataactgatttacccacaaattagataacaataagtgattcaagtttgcgagccataagaattgagtcagaactttaaaaatcaattatttagcagtatggagtgattatttacttagtgatatattttttatagttctctgcctcatatcatttcagtctatttagaaacctgctattttagcacaaaacaatatcaaggagaggagtgaatgtggtttgcagcagaaaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcatgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcaacagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatgagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgtctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttctgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggaggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcagactacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttgaagagaaacttggaattcgctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttcccccccgctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtagagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagagtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcaatattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaagattggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggatggcatccctgggcccagcctgccgcggcactcgtgggaagtggctggctggctctgctggctccacgcacagctggcatacactgacatggctgtggtttgcttctctctccttccttccccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgcccggagggcaccagctggccagagaccactgggcagaggaggtggggtggctcatctcgaggctacccctatttgatgatttctgtaggagtctgcttgactctgagacctggggaaggagtcgatttggggatgtgtgagtgagatgacattcagtcaggttgtgccccatcattggcggctgtgcagatacatgaagcgtgtgagcatcccctcctagcagccttctctccttagtggagagacttgtttgtttttcgagacagagtcttgctatgtcactcaagctggagtgcagtggcatgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctaggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcgcctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagaacatagacagttggcaatatagtgtctgatccagaaagcaagaaagaaaaggcagaaagtctgaagttttattttcactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacaatgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtctttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacgttatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcacaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggaaggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggtgttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggagtggcgtggtgcggtaaaaacaagagctgttggttttaaaggtttttgaagacaggaattactttatcttaccctgtttataatgtttgagaggggatgcagtggtatggtaggcatacatttttcaacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatcctttgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttatgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctcaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtagaaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagctaaatttaggaaggcctaatgatgacacacaatgctctttcgcactcatgatacataacttacagggaaaggccctgactccctttttgcatagcgtcactgggaacttcttgttaaatggggttagggagtcgttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccagcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacattgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacatgatccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtttaactccacatttcccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccgtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaactatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatggggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtcacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctctgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctctttcttttcttttcttttcttttcttttcttttcttttcttttcttttcttttcttttcttttctttctttctttctttctttctttctttctttctttctttctttctttccttccttccttccttccttccttccttccttccttccttccttctttcttttcttttcttttcttttcttttcttttcttttcttttcttttcttttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttcttttatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtgggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtcccctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctggaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttaaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtctctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcctaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttggcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgtgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcatccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggacgcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagagaattagaaacccagacatcttctgcctgattatagcagcagctagattgacttttgagagtgtacgcgtgtgtgtgtgtgtgtgtgtgtgtgtgtcttgggaggcatggaggcatatgtacctaatgcctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttcattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactgtactttttttttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctactttttttttttttttttcccgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctcagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaagtacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtgagcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagagcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtatttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccatgagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattcatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccataatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggccgggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatatagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggctttttttttttcttcttttctttttttgagatggagtcttgctctgtcacccgggctggagtgcaatggtgtgatctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatctgcccacctcagcctcccaaagtgctgggattacaggcgtgagccattgcgcctgacccaacaggccctcttaaaaccggggccatctggctgaaggtccatcatatagactctgctttctcatcattcttgtattttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagagagtttccttgtgcctctggctggtcatacccctctcctgatagacaaccactgttctgacttctatcaccatagatccatcttgcccattctagaatttcacattggtgggaatatacagtatggactcttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcaccctcatctatgtgaaccctgatgccctaaccctgtgcctacacccaagggtcctggagaggttgaagagacaagagggaggatgggaggctgctccagagatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagggctaggagaccacgcatgtgcaagcacacatagatatatattgcccatcgttcctaaccctcctaagggcaggaggccagaggtatgtgggttaggaatgctatgggctgcagctaagagaaaacctggctgaggctttcaactatatgacctcaaattagctccctggagataggtggccccagggctggcttagtaacctaacaatggcaccagtggcaccaggggtgaaggctctttatctgtccttgccttgcagaaggccaaggcaccttgagcaacatgtcaaagggcatcccaactggttgtattatttaccttgaagtgaagtgacaggatttgaactgtcagccctcagggagaagtgttccagctaccaggttttttttttttttttttttttttttttttttttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccgcctcagcctcccaaagtgctgggattacaggcgtgagccaccgcgcccggccgctaccagcttcttaagaaaaaaaaagcactgaaagcgcttgtggtgctgtccttgggtgctcctttgcttttatctcagaggctggcacatttgtaggcaggactgtgagacacagtctcccctgcccccaggagtgtggctggcccgctctgccctcaggaagtttgcttccctcagattagctccggggcaggtcctgtgtcagggtgataggcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtacttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcctctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcggtagcttaggtgaatgctgcctgagcagatgtctgcagtgggagcagaatggtgtgatttactctttgtttttgtgggatgtccttggggagcccacaggtgctgtccattcatcaagcactgggagatggtccatggcagggaggagagtatggctatttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactgcatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcccggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttttctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacagggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatcttcattttcacaagagccccacaagattcctgtgcacatttaagtttgagaagcactgctgtggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaactattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtttctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcataattagaatgaaggtctaggcttagccatagccccagaagtgttggggtaaagtggaagaggctggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttacactctaagggtgtgtttccccgataatcaggcttaaaggggatggtaactggagaattttgatatctcaatataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagtttggaaggtcagtcttcagatggaggaaagatgggcacttccaggacacagataccctccacttccatccaagctcagcagagggtgctggccaactctgtcatctccaggcctctgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttagcaggacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttggcctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggagggggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctccgatgctccatattagcagagcctcacagcaagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccgtggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactctgacccagtgctcctgtgtttccatggttagcctgaaactcgggaaggagaatttgttagaatttcacagctgaaatcttgttctgacggagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagtctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttgagttgcaagagatcagtacttccggatcagtacttctgcagtgagatgaaactttggaggagtaaagttggtgtttgtaaattatctagcacagtgcttggcacacgttgcaggttgaatttatttgcttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctcagttccctcatcttaaaaaatgaaggtttttgagcttagtggtctccaggattgcctcaaagctttgccagtctgaatctacccttttcttgctattgtccccattggagttggtgtgtgacacttgcacaggtgccagtgttttctgtgtgggagcactttcctgtatgcattattttcttcttaataatggcacctcctgagagtttccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccattgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttacggaggggatgacctctggcacagaaaagcagtaaaataggtgtattgacactgaagtcatatttctataatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggaaaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagccttttcagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagcggaggaggtggaagaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggaagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccggcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacggcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggcccggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcatcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatacctatgcatgacaggcaaataagcaggctcttcaggaccagggaaacgatggcaacagttctgagtctgatgcagggatggcagagaagcccaggcagagtgcaggggcagtgatgtcattccctactgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcacaccctgggatctgcccaggtgttttggcctgtttccattttcatatccaacaaaatgccttgggaccatggcttcaatcacattacatgctgtgggtttagagtgttggatgctggttttcagaggtgatcaaaactttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacgccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttactttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcaatcaaacttattttgttaaaaaaagtttcgtggagattgttccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggttgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttgtacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaaagaatgtagtaattaaactccttttgaaaatgattttaaaagaattcccataatattcaggtaatagcgataaaagcagctaacactaatcgagcatttagtatgtgctggttactgtgagtcactacatgtgagatagttactgtttttatcctcatcttactgtttcaaagacaaggcatagaagagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacggatgagccgtgtggacacagccacactatgttttcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattcggagccagctaaggttttctgagggcccgtcatgtctcagactgtcacacttattcctctgtcatgtatgcttaagtctgttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggtgatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgacctcactgacgaggtgtgatttgagcaaagcatggaaggaggctggggagttagcacagcgggttcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccaagcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgaggtcacattgactgtttcacgttgtacttagacatgctgattaaaacctgagttgcaagtgtaccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgggacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaaacactgggcccctttttccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgacctagtgcagctcgccagcccacgctgatgtgtgttaatggagggggtgccccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgcggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcatgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgtagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccacctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggttttcagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatgggattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtccccgcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcttctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttggttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacataattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttctcatcgataagacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttaccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgacgtgaagcacatttcttatgtcaggttcccagtttcctcttctgtaaaatggaggcagcatgggattgtaatgaggattaatggagctcatttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagttcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctgctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcattgcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtcttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctcacaatcatggtagaaagcaaagacatgtcttacatgggtggcagcaggcaagagagagaacttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagcccttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaactgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggatgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggcacagttctaaaattctttaagcctcgtttaattttttacctgttactgctttcatcatcacctctcactctcattttctaataagcctgaaaagcatgatggagtcataaatcatgtctgtaaaatgaagatgtgtaggctttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagctgggattttaacttcatcttctgcttcagggaccacattgttcccagtgtgtttaaacccctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaagttccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcgccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccaagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcatcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggaaaggttgaggtgggaagagagtgagggggaagactccatggagcatgacaggcatgctgtgcctgccacagccaagcatggaggtctcaaccataatgtgtttttgagacaggatctggctctatcgcccaggctggaatgcagtggtgcaatcttggctcactgcaacctccgcctcccaggctcaagccatcctccctcagcctcccgagtacctgggactacaggcgcaccaccaccatgcctgcctaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaaatggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcatgagcgtcacttggagtagaaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttagggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaataatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcagatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttacagtgctctgggaagcagggaagtgacctgatattgtagatattttcaaaaaatcactgtgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggagagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgatttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggctgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatcatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaattcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaacgcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgccaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacattccaagaagggaacatgaagaatgtttgtggctaaagaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagacgtgccatgatgagagtgatgatggtgatggtggcagacaagagcatgtcacatttagaaatactgtaactggttgctgaggttttacatatattctttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgttccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccaggacagagattaggctatggtgggcatttgagaccttagggccatagaccccgaaacatgcattctccagaactgagtatgcaactgtttgctttcgaccttacagcacaggctttgggagaaaacagttaagttcaggtcctaactccagtaatgaatttcaagcttcttgttattgtttttcttcctgaaagacaaagggagttttatgccatggtattttgacgacaatgttgaatcaattgttatcagatgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattattttatgttaaacggactctcctgcccggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcctgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttcctagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctgttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccgcaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagatattccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctccactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatcccattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacgcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttgtaatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgtcctcgtgtggacacaacttcctctgctctccttggccttggcctctttgctttaggatatgatgcccagaagggctcgaaactggcatgactcaggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggttgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtatttttttttttaacttccaaataaagcttgaagtgtctgagaggctgcataacagaggtgaagggcacagacttgggagccccatggccaggatttgaatctgaactcttaggcaggtccctgaactgctcagccctcagtttcccgtctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcagcagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttgaaaagagaaaggctacaactcagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcagtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacttcagtggcatacaatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggtgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcccatggggctctcaagccatgattctttacttaaccttcgtctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccaccatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaaaaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagttttttgtttaataatggcattttgtattaccaagaccttgcttcacattaggtgtttcgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctgctaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtagggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggtgcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaaatgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccatctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgcccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcggggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaacaaaactgttttcatcatctttggttgtagttttataaagaatgctggttcatggactccagacacttcactgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtctcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtaggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaagtttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctgggatcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagattataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgccctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctcccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccggttttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcgtggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattggggaggattccctctttttctgttgattggaatagtttcagaaggaatagtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggttttttgtgtctctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaagggcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgccattttttgttttccgtttgcttggtagatcttcctccatccctttattttgagcctatgtgtgtctctgcacgtgagatgggtctgctgaatacagcacactgatgggtcttgactctttatccaatttgccagtctgtcttttaattggagcatttagcccatttacatttaaggttaatattgttatgtgtgaatttgatcctgtcattatgatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgtcactttcaggtacaccaatcagacgtagatttggtcttttcacatagtcccatatttcttggaggctttgttcgtttctttttattcttttttctctaaacttctcttcttgcttcatttcattcatttgatcttccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggaggctgcagaacagtggatattggtgaacagcaaatgtagctgcctgatcattcctctggaagttttgtctcagaggagtacctggccgtgtgaggtgtcagtctgcccctactcggggatgcctcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccggtaggctccactcagttcgagcttctcagccactttgttaacctagtcaagccttggcgatggtgggcgcccctcccccagccttgctgctgccttgcagtttgatctcagactgctgtgctagcaatgagcaaggctccgtgggcgtaggactctccgagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcacgcttggtgtgctgcacccactgtcctgcacccactgtctgacactccccagtgaggtgaacccagtacctcagttggaaatgcagaaatcgcccgtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttggatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctacaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgcttttttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttcttaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttactttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaaacaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgcgttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtatgtgtgtgtgtgtgtgtctgtgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcatcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagattttccctaaactaattatctggcttaatgctaactgcttatttgctgaccttctgctttatttacaaatttaaagtggggccaacccttcctgttttcctttaatttaccccggcagctgctggttagctaaggaagaaaaaaaaccctttttttttttttttttttttttaatggagacaagcagcaattaggtaggcttctaggtcaggtggccagttaggggtgccagggttcccaggtccagctttcttcgggtcatagagtgagggtgggaatcaagtcactcagatatttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgcagtccgctggacagcccatgccctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctcctcagccaccatggcttgaatggctgcatttagaaacagcccttacttcaagcccctatttcttaattatttgtcacttattcccattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagagggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtataatggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgaagtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttccctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaatgcagatgtgagccataagcagcctacacacacatcagccaggagatgggccacagttcacagtgcccactacacatcaaaacacaccctctggggaatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctaggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtgaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgccttctggtaccccattgcaatgattataaatgagtagatcggaacagggaggacaacactgtgaaagaaagggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaaataaactgtttaagatagtgtgggcggcctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcacaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgaacactatactgaaaatgaaaaacaaaatggttgtatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctataactgactgggacctgcagctcactcccactgcccagcatcacaggaagtattgtaccacatattgctaccctgggaaaagcttttgaaataaaaaatttgaaatatggtttctactgaatgcatactaccttcacaccattgtgaagtcaaaaaatcgtaggttgaaccattataagttggagaccgtctctatgtcatggttaaaatataaaacaaattaaaatgtgataaaataaccagttataactatcagatgttttttgtaagcctcatggtaaccacaaggcaaaaacctatagtaatacaaaaataaaaataaaaaagcaaagaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaagtcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagatagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcggtgtttggtttttttgtccttgcgatagtttgctgagaatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcgtgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtcttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcataagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactaataatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaaaggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtccgtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcaggcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttattactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgcccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcatggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacacggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaaatcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccatatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgcgtgactcaggtctcttgattccatggtgtattgtttttttacctattaaacaattgcattcctagcctatggaaggtcttacctaagccaagactttggcagggattggattgtgcagcccatttttgttaatagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagtttttttttttttttgatagtaagagcacttggaatctactttattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaaccttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaattgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggagggaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctgttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctcttttttcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagataggcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactataatctgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctgtctttctcacagactgtttttgaaaggaattgccgttcagaggactgtgccgcagacctgcagcttcagggtaaactgctgctctccaggtatgtcggtgtttccttcagagcattgttctcaggctcctttttcttgaccccaggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacactagtgtatgttttaacaagtaacatttctgtggcaggagagggctgaaggagaggggcaggctgccctgatccaagtgagcagatagtctccttattgtttcagggtttcctcccgcactgcatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgctgaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatgggatggctgggtcaaatggtatttctggttctaaatccttgaggaattgccacactgttttccacaatagttgaactaatttacactcccaccaacagtgtaaaagcattcttatttctccacatcctctccagcacctgttgttttcttgactttttaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttcgcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatgtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatggttgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctgtttttggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctctttttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaccagctcctggatttgtttattttttttttgaagggtttttcatgtctctatctccttcagttctgttctgatcttaattatttcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctattaggtctgcttggtccagaactgagttcaagttctgaatatccttgttagttttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctatacgtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccaccttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttggatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttgtctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccaagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggtgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggggcgaagtgcatttcccaaaactgttggctagctgagggatgagagctccatccatgaaaaccagtcttccagaggaggatccccaaacccagagagctatttagagtttgaaacaaattgttctccttctcaaaagtggcagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttacggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggctttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagaagtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttgttactgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgctttgtccccagtagtcactggccacggtgagacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgcaagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgctctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgttagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaacataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttgcttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggacagaaataccaatttttattattctagaatagattaaaatataaaataaaattagattttctctaatatatttagaattgaacctttttgggtacaatattcttttttagtatttcttggtgatttttttttttacaacaaaaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctccttaactccactcactttaagcagcatctctggcagtagctacttctcctccaccgtcttagctccctcttggcagtcccagtcccagtcacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatggggaggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtttcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgcaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcattgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccctatactattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatataaaagcacagcaaagagatccatgtacaaagtaatataacccacttaaaagactgcacaagcaaattaaaataaaaagggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggggggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatgtgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacggatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaactgttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttaataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcgattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatccagtccatgagaaaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggacacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggtaaggagggcatccctgtaaaaagagcagttgttccatctggtgcgcttgctgactttcattattgcctggaataggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatcttggctcactgcaacctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacggggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaagcaatcaaggactgcaggaggggtgtgctttccatccactttctatattctaaaaattaccgctggattaagcccagtcaagagagaaccaagtatctgtatggttcaagtatcgctggccacacacacagtatcttttacagaatcgcatgtgctgtgatgccatctccctgtgcagggtgggttggtaggtgggggaaaggggcttccttggggatttgatctgtggaactcatctctgtggtaactgaaaagatgtaattggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatccttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattggccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatcacccagcaccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagaaaattgatttaatgatgcggaggtgtttttgagaggctctgagaattcagagaaaaagaacaaagcaataaaaaaggatgacatgaggactatattgtggaaggtagaaactggaaaacagcaaagagaaaatggttccagaataattggaacagaagccattccttagacagcaaaggaggatctccatttcctgaaatgggtgcagcagacaccaggcaaaaatatttaaaacattttaatgtctacaaatagcttcatgaaatttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgttgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctagccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtacacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaccgtgttgcctgccgggcaaggaaccagcaaagcctcactacagagtgacaattcctggggtgccctgtgggagcagtgagagggagctcctggggccggggggtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaattttttgccctggagccgtttggcacaaaggactttggctcttcttgcctttgtcaaacagccatgaatttgtttggacagcagttgttgaatgcctgctaaatgctagggactgttccagccacaaggagacacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaacccggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcaaacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatggggcttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcacccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagagagtgtgtgtgtgtgtgtgtgtgtgtgtgtgtgtctacatactgtaaaaaaaaatagagacagtgttaaactgaacattttttaatttaatgagttgcttgtacttaagaaaataaaattatatgaaaattaatgtgaagcagtaaatataggtcagttcaataaatgtctgtgttggcttttgtgactcctgatttttttaaaataatgcttgttgattttttttttccatttacttaccatttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagaacagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgtacctggcatcggttggccataagtcactgaatttggctaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcacctggctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccgccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctcagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcctgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacttctgttattattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgcccccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctattggaaatagtgctgcaataaacatacgtgtgcatgttctttatagcagcatgatttataatcctttgggtatacacccaataatgggatggctgggtcaaatggtgtttctagttctagatccttgaggaatcaccacactgtcttccacaatggttgaactagttgacagtcccaccaacagtgtaaaagcattcctatttctccacatcctctccagcatctgtggtttcctgactttttaatgattgccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccggaaaagggaaaccatcaggaatcagaaatggagaaatgcttcccccacctggtgattgcatcttgctgtatgggatcaggcctgaaaagtgagttaagtctgttggtgctggaactcatcactgaggaacagcctatgtctgtgccttcaggggtgacagacagtggaccaaggccatgcctgcatattcctccctggacccctcattcaaagccagaatctctttcctgccagagcagtcctttgtccacatgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttgaggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacggtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagtttttctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacatatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttctctgtaattttctttcttgtcaggttttggtgtcagatttctgctagtgtttgcaaaaataagcagaaagcttgcacttttctctgttctctgaagacatacaaccaacatagttgcaacagcaggcagtgagagctgacccttactgagagcttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggcacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcataggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaatgattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattctttctctctactaatgttttcacctatggatgtcagttctacttctccttggggctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaattcaaggtgggggaataaaatctacctcgtgatgggagtagctgcgaagtcaaaactgcaagggatgtagttaaagggagggttggagagtgggcgtttttgcaaactatctaccccaacctctgagcggtaggtataattatcccagtggttctcaaccaagggtaattttgtctcctaagacacagttcacaacttttggagaaatttttggtttccacaactagttcagcgctattagcatctagtgggtatgccagggatgctgctaaataccccacaatgcacaggacagctccccatacaacaaagaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccttggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaaccctcgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcggaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagtgggttggggattccagagtggttctggctcgaggtctcttatgagactgcagtcaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagcttagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttagggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctgtcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagggggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctgagctgaggatgaccctccaggtggctgagattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagcctcatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaaggggcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtggtagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcaagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgaaaaaatggtatggaaagcaaggcacctgaaaaaattttcaaagggagaaaaagaatgagcaaaactatcctgtagaggagagagacattgaaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagaacaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagagacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagaacagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgagaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactcaaagacagagaggaccataataccagggttcctcagtcctcaccagcataagaatcccagagaaggcattttttttctcacatactctaggtctcaatctcttaacttcaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattaattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagaggtgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctttctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcgcagaggttagcttctaactcatcaggtctagggtggggcctgagaatctgcatttctaacagtgagcatgtccagggaccacactttgagtagcaagaccttgacagcttcaagttgcaaaccagttttgaatgagcagagtagaagggggtttgcaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccagtgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctctttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggcctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactacctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgacatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacgaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaattgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagcgctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaataaatctttttgatttcttttttttttttttttttttttgagacagagtcttgctctgtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggaaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgctgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatcctgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttacattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacagtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgttttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcaagatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccttgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagccctaggatctgtagcttcaataatataaaaatttctagtttcttaaatcacaaatgttaagatgaccatattatcttctaagcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctgagccggccaaacaaacggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaacaataggagggagaaggagaggggatgtgagagctatttaagtgctgttgccattcagcacttgctggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccatagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctcctttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctataatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatctgccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcagggaagcactgggtgcaagacactggattaaattgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttatttttctcctttgcttttcgtaattgggtaggaaatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaatataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagtcttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgttaaaaataaagatggtaatacaagctctcctgtcctcctggctctgatgagtgaaatagtgcaaatcagcatccttttcttcattgcttaccccattcatgcttgaaatgggatttcccagacatgccaggatgtttctttttaattctgtgcactcatgtttcacttcaaattagttatttcagctatggtcagatattccttccttttctatgtcttcaggttgtttggtgaatattgttcttttttgaatcaggagttggcaacccactcatctgctctatcagtttttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctagctaattttttttgtggagagggggtcgggttttagatacggggtttcaccacgttgcccagctggtctcaaacatgcctgcctcccaaggcttattttacttagcataatgacctccagttccgtccttgttgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccacctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggccccgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggcaaccgctaatctactttctgtctctagagatctactcactttttttattcctctgcatattctgtttcttcctcgagtttcatgttcagctttttcctctccctccttgctcttactggtctctgtgacctccatctttttcctcatttctcaggaaatgattgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatgcatgtaaaaagaaaagttttagcaggaagaagacaaaatgctgaaagagaatatggtagtttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggcccatatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacgtgaacatctacagtgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagtagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggatgggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattactagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgtttgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggaagagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcataccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacaggcctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttagtagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaatcaccagaggcaggctcagtcaataggacagacagatgaggagtagacccccaagaatcacccaccagaggaggagcatcaacaccagggcagagaggcagcaaccgcaatcaaaagaactaataccagagggtgcagtaacaaggccaacagaaggcttctgaataagcaagactgatgtcttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatctggaatgaaaatatcagatgatcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattttattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagaaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctgcacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaaattagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagacattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaaaacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatggagtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttactatctgagaactttagtcctaataatttctctacaccaacttctagtcctaataatttatccgtataatgctcagaaacactccgagattctcagtaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttattatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccaccagattaaaaacaccatgagagtaaagggcaaggtccttattttctgtgtatttgcagcatttggtgccgagaccatagtgagtggtgagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccggctgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgacggcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtgggctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgggcaataagagcaaaactctgtctcaaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgactgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtggcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctttccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcatgtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtaattgggcctcctgttgcctctcagcttgcctccatctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtggcgtgtgcctgtaattccagctactggggagggtgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttagttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccagacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctatttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctaaggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaagatccacattttctattatttggccctgttgatgctacaacttctgcctttcagcttttcagccattgttctccacttcaaaatggacaaggaggaaaggtgaattggggttctaccactcctgcctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaataggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccgggcacggtggctcatgcctgtaataccagcacttagggaggctgagggggtggatcacctgaggtcaggagtttgagaccagcctggccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgctttccaaagcctccttttttttatctttggttacatttctctaagctccttatttcagccctggcacatctcacctttatcatttcctttctcattcttttctcctgttggagaagggtgactgtttgccacttgaaaggttgggttttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaaagaaaacttttgtaacttaaatttgggatttatgtttttggttttttgtttgtttgtttgttttgagatggagtcttgctctgtcgcccagggtggagtgcagtggcatgatctcggctcactgcagcttctgcctctcgggttcatgcagttctcccgcctcagcctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttattcacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaacaggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccagggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccgcaggccaggctggaggactatgcctctgcatatgtacctgtcctgtttgtattcttcaaaaatggtgctgcagacagttttattgcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctggcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattattattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacaagacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcaatatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccaggccccccctggagaacttctgtggttcgttcttgtgatagcattgtcctttaggatgccatcattatgtgaatgtttcctgctatgattgtccaaagggaaaatggtctggaagtacacccacgtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttgaggggggttcatcctgtatttgatgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaaaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccattaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgatcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatttcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatacttcttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaaagtcaggagatcgagaccatcctggctaacgtggtgtaaccctgtctctactaaaaaataccaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaatttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcatgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaagcgtgcatgaattcttgctattttcttgatattttcaaatagcagaatacatgataaacttgtaagtccacagatgagtcggtaagctgctgccatatggagcatgcaccagactgaggtctttggtgacagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttactgcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggacgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatgagacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccagaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacagccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttattttattttattttattttggacggggtcttgctctgtcacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggtcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagctttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgccccaccgcactgcagcctgagcaacggagcaagactccgtctcaaaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacggagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggccctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacttttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagaaggagtatcctgttagagcttccttcatggcaccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatagaccaggcattctcataacatcaacttatttttgaatagtgtattagttaaattttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggcctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggagccaaatatttgcacaaatctttcattatgtcgttaggttgaaagcctagaaatagaattgccatcaaaaggagtgtatattttaagctttttaaaaattatatttatttttttattttgagatggagttttgctcttgtctcccaggctggagtacagtggagtgatctcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgcgccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttctggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaattttcaaaaaatttctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcagagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatgcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaagagatgacagtgccttcaccttgttgttagcaagaattgcatacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccagtatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaacttatttgaccatgaaaccttttttttttttttttttttttttttgagatggagtctcactctgtcgcccaggctggagtgcagtggtggcacgatctcggctcactgcaacctccgcctcccaggttcaagcgattctcgtgccccagcctcccaagtagctgggattacaggcacacaccaccatgcccagctaatttttgtatttttagtagagacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggacgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagagcaactaacttgcctcctgccggggtgtaggtgcgttggtgacagtgtagaagggtgattcgcaggcccatgttctgcccaccagcaaagccccactggagaagggtagactcctgtgggcagtctcagagctgggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcagtattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaagttcaatctgtaatttacttgctaataagaactttttaaagtgttgaagctagggtttcaatgtaatacaacatgagcattaaagagaacatcaaggtccatctaattcacatgaacaacccacctgatgtggctgaactgtctgcagtccttggcctccacacaagaggtaccacctcctctctgcatcaccctgactcccctggcccagggctacacctaggttcttgatcttgagataaatgtgcccaaattaaatggtatggattccttattatcagtagacttctttcacatgtgcctgccagttactaagcatttttccagaagcattttgataacattcttacacatttacaaatattgtattctcttaggttttcactctccttcatctgtctattaatagttatgttcttgttcatattccacatgctgttcatttatgtgtttttttttccctagacaagactgttaccagataggggttccaatccagacaccaagagcaagttcttggatcttgggctatcaagaattcgaggctagtccctaaactgaaagcaagtttattaagaaagtaaaggaataaaagaatggctattccatagacagaacaggaccagggctgctggttgcccatttttattgttacttcttgattatatgctaaacgaggggtggattatgcatgagttttcagggaaaggagtggacaattcccggaactgagggttcctcccctttctagaccatatactacggtaacttcctgacgttgccatggcatctgcaaactgtcaagacaccggtgggagtgtcttttaacatgataatgcattataattagcacataatgagcagtgaggggaaccagaagttactcttgtagccatgttggttttggtgggttttggctggcttctttataacagcctgttttaacaaggtttttatgacctgtatcttgtgccaaccccctgtctcatcctgtgacaggatgcctaacctcctgggaatgcagcgcagtagctctcagccttattttacccagcccctattcaagatggagttgctctggttcaaacgcctctgacaagaccaataaagatctatgtattttcttggtgtttttcaagagtaagcctttggctgtaccaatcaagtctactgggttttgctttctatttcgttactgcttttagatttattaaaatttcttctattgcctgatggttaaaattcatacacatagacaccacacagtataaaagagttatgaaaaaatatacaccaatgggttaagaatgattgtctttaggtaagtgagattgtcaggcttttgctttgttttattttgtttttatttgaatattcgttttctacagtgagcatgtattttgtaacaatgaaacatatgcagattacttgtaaataaaattatatctgggagactataaattgctaagccaaaagagatgccacattgtaggtctggaaagagatttgttgcagcaaagagcattgatgagcctgacacttatgacaatggtccagtgagtaatttcaagcattttaattccagtgcttcctggcttaacaaacctgccaccattactaatgctaattaaataggtttctctgaggttgcccaacctgttttcctaagccaggaaatggactcgacaaactcaaaagaatcaaaagatacaaatttaagaggaagaaaaatcactaattagtgaagtctgcttcctattcaatcaggagttttacagctcaccagattacctctcatccttaaagtctgtctggtcctcaggttactgtttagtaacagaattgatgtaagaattacttagagctcaggctgcactatcagaccgactggcagctatccatcagcaaagccacctgtccctaagatcatgtccgttcactctatgtatacatgcaactaaagtgtgtataatgagatattgccatccctgagctgaaatctaaggctgcctgctgccaaatctctgctttgcttcaaagtccaaattattttatattttattttaaatcagttttttaatcctaaaaattaaacctcaataaagggataactactatcctttgaagacaaccaattggtattttaaaaagttggcatttaaaaaagaatctccaggaaatgtttcttctagaagatgactgattaggaaaaaatgaaattatctccaattccacatctactctgaacccaccttatcaggagaatatttggctccatataatagaaaactccgaattaataaggccttaaacatgataaaagtgtgttcctctctcccaaaaaaagaagcagaagctctggtacagcagctccatgggcatcaggaatccagctcctgtctttctcagcaccctcaaggttgcctcatggtctgagatgactaccagggaactagctatcatgtccacattccaagccaaaaatagaagaggacaaaatgacatatgccccctcccttttaactattcttcctagaagttccatataacgctggccagaaattaattatgtatgtagatatacccacccactaaggaggctggggaatgcattattaaggaataagaggagggtaagtgttaagagacaactaccagttgccacaccctccactgagaaaatattcagactatagctgccttgagctctaaacttgtacgcttcaaatccttaagtctggctggatttaagcaagaggcaaacctttatttgggctggagtcagggatggggtggatgcatggagctggttaatcatattcatgtccatacaaagccctttcttcttttatgtaacttttctcctttgtgtccccaccctcactcacattcccctctctcccagaggaaccaagtctaataaatacatgcccttaaacatggatgtacatcatattattttttatgtttcacttaaatggtattgagcacacactgttttatttttccaggttgtattgatgttgctgtgtttacatttggttcattgtttctggctacagcattacattctacattatgttttcagcacatttcacttctccagcccctctgaaggaagcctttgctgctttcactgcctgctgcagtgaacactcacatggccctttatgggtggagctagaatctcatggtatctatcatatatatgacatctgaaggtggttggttacgttctcatttcgttgctagattctctctaaaatgaccacagactggacactcccagcaacagtgtatattcccacatccttgcccaaaatggaattatctgacctaaaatgttagaattacttatctttttctgatgaaactgaacattctatcattatgcactgatccttttttatctttagtaatactttcttatcttaaagtctattttgattagtatttacacaacatatctttttccatccttttattataatctttctatatccatgtgctttggatgtgtcatttgtaaacatcatacagctgaatgttaaaaatccgttctaacacaatctttatcattttactggaacatttattttatttacatttattgttattaatgaaataattggatttatttctatcatcttttgtgttttcttttgtccacctttttatacttttctctcctttctcttctttgttttcacattccattcttcccctccattattcacttttattctttatgcagataacagatactttaaaactttaagccttacaatagccaggcacagtggctcatgcctgtaatcccagcactttgggaggccgaggtgggagaattgcttgagcccaggggttcaagaccagcctgagcaacacagagagacccccatgtctacaaaaaaaattttagctgggtgtggtggtgcacacccatagttccagctacttgggaggctgaagtgggaggattgcttgagcccaggaggtcaaggctgcagtgagctgtggttgtaccactgtactctatctagcctgagcaagagtgagaccctgtctcaaaaaaaaaaaaaaaaaaagacttatacaatatcttacttatttaacatatcacaatctagagttagtcactagtcactatcttttaatgtattttaattttatattttaaccacataaatcattgtttttgctgttttctttaatgaatgccagtctagatttgcccctatacttgccaccttcttggctcttaattgcttcttgcatctcagatattttctcctggcatcattttccttgtgcctagtacatcctttagaatttccttcagtaagaatctgctgatggcaaatgtttccattttgttttatctgaagctgtctttaattgcccgtattcttgactctttgctggtacagaattctacatcagcagttactttcagtggatgaatataacatttcattttcctcttgttcctgttgttactataaagaagtcagcagtcagcccatttgtcactcctttaaagggatcctgtcttttctcttaggtttctgtgaagattttctctttgtttttgtgtgctgcagttttcctctgaagagttatatggcatttatgcttaccttttctgcttgcaatttgctgtacgtctgtggtttgaggtctttcatcagttctcttcatctctttaaatattatctctgctccattctctttcctctcgctttatccttcttgcctctttatctaccactcctagttccatcccatcatccctctgtgcagcattctggactatctcttctagcccatttctgtattcactatcttttcaacggtgtcaaatctgctttgagacttgtttgttaagatttgggtttcaattattatattcttatatccaaaggcttttagttctccctcaaatatgatgggcacttctctgtattttcttgtttattgcatataatttcaaatttatttctttaaacataaaaatcatagtttccattttgtgtctggtaagtgcaatgaagtttttatggctctgtttctgctttctaggatttttcccctgatgatcgtcactcttggtgcttggtttccttgtgcaactagtggtttgttggtttgtttattgttagctgcttattttccttgcaaaattacttgtggtaattctttgaggtccaggatgaaatatgttctatagagagcctttgctttcacctctgccaggcaccagtctggggccataccttgaggttttatggaccacccaaataacatgaatttgaacaacacagtcatatgaaggccagcttgtggttgccacttctcagcatccctgtcaactcctgtgatctgctctgcaccatggcaactttcctcaaagttttccttggtcctccaggagtactagtaggaatagcgtttctccatgtggttgaatcttatgttgaggttgcagcccttggagatgctgctttatgggtccctgaacccttcgaggccatgaaaaccaaacttcacttttgtaaggcttgccacatgctcaggactaaaatgattgaagccctccacttatctctctgcctcgcagacttcattccaactttggcttgataatttcatactttcgctatctttttgatacatttaagaatatgtcgttcaaaatattttattcttcatttttagtgttttgttgtggtggttgttgggagaattggtctacttctcttcctggatcagaagtctagatatctgctttccatgtatctagtttcctcatctctctctctctctctctctttctctctctctctccctctctctctctctctctctgtgtataacatttttattataaaacttttcaagcgtacagaaaagttgaaagaattctacaatgaacacctaaatattcaccatctagattctaccatcaaaattttactatattgggtttatcacatatctacctatccaggccaggtgcagtggctcacacctataatcccagcactttgggaggcagatcacctgaggcccggagtttgaggccaacatggagaaaccccatctctactaaaacaaaaattagccaggcatggtggtgcatgcctgtaatcccagcactttgggaggctgaggcgggtggatcatgaggtcaggaattcaagaccagcctggccaacatggagaaaccccatctctagtaaaaatacaaaaattagctgagtgtggtggcaggcg

SEQ ID NO: 1113 - DNA, 115908 bp, Homo sapiens
tatttgaactgaggaaaattccactgagacagtaaacacttgaaagagtaaagagccaaatgctagtccactgggcactaaaaaggataaagattcaggccgggtgtggtggctcacacctgtaatcccggcactttggaaggccgaggtggacggatcacctgaggtcaggagttcgagaccagcctgaccatcatggagaaaacctgtctctactaaaaatacaaaattagctgggtgtgatgatgcgtgcctggaatcccagctactcgggaggctgaggcaggagaatcgcttgaacctgggagacagaggttgcggtgagcggagatcatgccattgtactacagcctggacaacaagagcaaaactctcgtctcaaaaaaagagaggataaagaatcaaactcgagtcaaccaaatccacaaagcagtgacaagtctaccacggtacctcttagagctacgcacatcttgttctaactccagttcccggcgctggcttcccccacagcatgtgtgaactttctcacacgcatccgctcctctccactcccaagttccaggactgtggtgatgcaatgagaatgagtgtgagaatggtggcaatgcaatgagtgtgaaacccacgtatcaaataccacgaatgcccgtgtcttcccatagttccctgtacacgattcggatccaatgcacagtcctacctgccttcccagctacacagtccccactgcacactcagcctcagccagcttggctcgtgggctttaccatagttttcagtgtccagcttccctacctttgcccaggtggatctctcctctgttcttcatggcttcgagggtcagcttacaggtgtctctctccttcatgaaggcctcctcaattgctgtcctcctccaaatgtccacacgataggatctgtaccatttagagaattcattgctttctccctcgctgtcacagttgggtacatatctgtcaagcaggaaaggccttcaacagtctgaccacaggacctgcatgaagtaggtagtcactgaggcttgtagaatgatgaacaaagaacgaatgaatgaaatttctaatcacccattagcctgtatacttgaagtgtctggggtagagtgactaagtgacttttatttttgtgtgtatattaatagaagattacttttttcttttttgagatggtgtctcactctgtcacccaggctggcgtgcagtggcacaatcatggctcactgcagccttgacctccttgggctgaggtgatcctcccacctcagcctcctgagtagctgagactacaggtacatactacacctggataatttttttttttttaagacagagtctcactctgtcggcaggctggagtgcagtggcacaatctcagctcactgtgacctctgtctcctgggttcaagtgattcccctgcctcaccttcctgagtagctgggactacaggcgcgcaccaccacgcctggctaatttgttgtattttagtagagacggggtttcatcatgttggccaggacagtctcgatctcctgaccccgtgatctgcctgcctcagcctcccaaagtgccgggattacaggcatgagtcatcacgcctggcccctgggtaatttttatgttttctgtacagacagggtttcgccgtgttgcccaggctggtctcaaactcctgggttcaagtgatctgcccaccttgcgctctcaaagtgctggggttacagctgtgagccactgtgcctggcccatagaagatttcaacagacgtaattccaccagagcagtaagttaaaattcgtctcctgaagtaacttactcatcaccaagactccaggtctgtgctgagtgcagcccattgacaaagtgtaaccagatgaacacacacactgatctcataattagcatctcacagggtgcggctcccacatcaccaccacctggagcacatgccgaaaaatgcggaggcccagatccaagccaagctagagcgtcagagccttcgggggtcggagcaaggagccagtgtgatctcggctcaccgcaatctctgcctcccgggttcaagtgattctcctgcctcagcctcccaagtagctgggactacaggtgcccaccaccacgcccggctaatttttgtattcttagtggagacgggttttcaccgtgttagccaggatggtctccatctcctgacctggtgatccgcccgcctcggcctcccaaagtgctgggattacaggcgtgcgccactgcgcccacctataatcttgataccaacagaaattgtatattcctgtcacattacagctaccgcaggtatctcaaaatataatgtaagctcatcaccactttggaagtagggtagttattagacctgctgctttaaggcattaataaagatatacaaacatctctatataaatttttaaaaacattctgattgttagatttcaatgtaattgatttttataaacttttattgtttaaaaataagctgatagacggttgggaaaacggggcaaaacaagcagaggaaaatgctaacagcagaaactaggtggtgggcagaccggtgttcactgtagaattcgacttttctgtatgtgtgaacattttcgtaatgcaacgtttgggaaaatacctgacaaggggttgctggaccaccaaaaggatctacagcccaccgaacagtcagaaacccctaacctagaggtactggtgtccttaaccagctagccaatccagtcagttcttcatccgggagccaaaagaccccaggcctgggtatcccaattccacttaggctggcagccttttgccagactaagaaatcaaaaaggtttgcagcaccaaagtgagccagtggtgttttctctcattcatcccagcactccaaccttagcctcagatctcacagctctaaagagaggaaagatcacgccgagaaaccaaagccaagagctcgaaaacgtctggcagttctgggaaggactagtccagacccccctctcggccctggacagaagatgaggcatccacagagaccacaccttcagtccccctgactactgtgcccccaggactgcaactggctgcggggtcctaggagatggttaaccaggaatctcggccagacgcggtggctcacgcctgtaatcccagcactttgggaggccgaggcaggtggatcacgaggtcaggagatcgagatcatcctggctaacacggtgaaaccctgtctctactaaaaatacaaaaaattagtcaggcttggtggcgggcgcctgtagtcccagctacttgagaggctgaggcaggagaatggcgtgaacccgggatgcggaacttgcagtgagccgagatcatgccactgcactccagcctgggtgacagagtgagactccgtctcaaaaaaaaaaaaaaaaaaaaaaacaccaggaatctcctcctcagggacagagggagggcaagggcagggcctctcccagaagcggaagggcaccgtggtcctgtcttctccctggtggtacttaggaagactgtttttcagacagaccaccaatgatgacggctgcttcctaatgcccaccacctcatctgtaagacttagctcccccactttggagagcacatggctctctaatcctattaaagtcaaatcacccttacttgcccaaaggctcagaagttcagaggtagaaatgcacctcttctaccccagaagcagggagcagctcagaaaaagctaatgagaaaataccagggtcatgttgtttgaactggacaagaaagaaaaagcatagaggaaaaaaaaaaaagtcatcttaattcatggaaaaatacatggccttgccaacagtcaaagaaaagtaaaactgaaactataattatatacccattaagcaaacaaattaagtaaaaatggagattccagaacaagttcacgctgctgataaccacataaagtggtccggtctttctggaaagcacttcggcactgcagagcaattacaaaaagtttttaattccactcttggaaaaagctaaaagggcttctttacaaattgtgattaattccccaaagattatgttagcccaagatgatacccttccctctattcccccacctgacccccagcatttagcagcagcatttagcttctgacatgcattccttgaaaacggtcacaaatggcagaagataccatcttatttatgcaacccccctcaaaaaaaaaaacctttgtacttagatataaatatatataaatacttagagatgcacagaatatggtttggttttctttcttttcttttttttgagacagagtcttgctctgtcacccaggctgtagtgcaatggcacaatcttggctcactgcaacatccccctcccgtgttcaagcgattctcctgcctcagcctcccaaggaggtgggattacaggcgcctgccacaacgccaggctaatttttgcatttttagtagagacagggtgtcaccatgttgggcaagctggtctcgaactcctgacctcaggtgatccacccacctcggcctcccaaagtgcccggctcagaatatgggtttggaaagatacacgttaaaccaggtcatctcagcctctgaggaagagcattgaatgaagcaaggttgcgacaaaggcaaattttcactttttactgatttcactatgagaaatgtacctattactcatgtactttacaaaatttgctcccactaataaaaaaacaaagcaagtcaaccgaagttgggaattgtcaatttaggtgcatcctcctgaactctgctattaggacgacgatgcttcctgaagtgattaagtttccctaagccaggcacagtggcacatgcccttagtcccagctactgcagatcacttgagctcaggagttcaagtccagcctgggtaacaaggtgagaccccagtctccaaaagtaaaagttaaaaaattttaatagccaggtgcagtggaggctcaagcctgtaatcccagcactttgggaggctgaggtgggtggatcacgaggtcaggagttcgagaccagcctaacatggtgaaaccccgtctctactaaaaatgcaaaaattagctgggcatggtggcgggtgcctgtagttccagctactcggggggctgaggcaggagaatcgcttgaacccaggaggcggagtttgcagtaagccgagatcatgctactgcaccccagcctgggcgaaagagcgagactctgtctcaaaaaacaaacaaagaaaaacaaaacaaaacaaacaaaaattaataaaatgaaagtttcccttgattccatatactgaatctgttcctagttcaagtaatggtaaaattctggtgccattataatataattatgactagaagacccagaaaatcttaaccaaatacccctccttgtaaatgtattagagatgtgcacagaataatgcagtagtgcagattatttaagactgcaggaggccgggcgtggcggctcacgcctggaatcccagcactttgggaagccgaggtgagcggatcacttgaagtcgggagttcaagaccagcctggtcaacatggtgaaacccagtctctactaaaaatacaaaaattagtttggtgtggtggcatgcacctgcagtcccagctactcaggaagctgaggcatgagaatcgattgaacctgggaggcggaggttgcagtgagccgagatcatgctactgcactccagcctgggagaaagagcaagactctatctcaaataaataaataaataaataaattaataaaatgaaagtttcccttgattccatatactgaatctgttcctagttcaagtaatggtaaaattctggtgccattataatataattatgactagaagacccagaaaatcttaaccaaaaacccctccttgtaaatgtattagagatgtgcacagaataatgcagtagtgcagattatttaagacagcaggaggccgggcgtggcaactcacgcctggaatcccagcactttgggaagccgaggtgagcggatcacttgaagtcgggagttcaagaccagcctggccgacatggtgaaaccccatctctactaaaaatacaaaagttagttgggcgtggcggcatgcacctgcagtcccagctaattaggaagctgaggcatgagaatcgattgaacccagaaggcggaggttgcaatgagccgagatcgcaccactgcactccagcatgaacgagagcgagaccctgtctcaaaaaaacaaaacaaaacaaaaaaaactgctgttccctccaataactgcatccaaagttcagcgggtcccagctcagtccttttctgggtagcagagtggccctatggcatgactcactgttcttggatctatgcaagctctaccatttcctgtcccaggcagagggtgaaaaggaaatgagaaaggcctagcacctaaaaggcagcttgtagaagaaagaccggctgggaaagtaccccatgtgctttctgttctcctttgccctggtacaggatagtgagtgcagattcgaataacctgtttctctcatgataccatctgaactttggagggatgaaaccaatgaaaccaagcaggtgtgaaaacctaaattggccacgttatttagacctcattcaattacgagaaaaggttactccacagggctgagcccagcactcattcttttttttttttttttttttttttttttttgagacggagtctcgctctgtcacccaggctggagtgcagtggcgcgatcttggctcactgcaagctctgcctcccgggttcaagcgattctcctgcctcagcctccagagtagctgggattacaggcacccaccaccacgcccagctaattttgtatttttaatgaagatggggtttctccatgttggtcaggctgctctcaagctcccgacctcaggtgatctgcccacgtcggcgcctcccgaagtgctgggattacaggcgtgagccactgcgcccggcctcattatttatttatttatttatttttttgagacagggtctcgctctgttgcccaggctggagtgcagtggcacgatctcgtctcactgcaaactctgccttctgggttcaagcgattctcatgcctcagcctcctgagtagctgggactacaggtgtatgccacagaccttggcccaagccatagcatatgaatttgtaaaatctaaccatgtcgcacttaaaagtgtcttcctcctcattaagtagttcctgatgtagttcccccgattacagctgccttgctctaacgccaattggatcagcacgactcagtaagtcaataacaaacaggcttcccagtgacgatggaagtggggtcttatttgcaattttaaaaagtataaaaagcaggggcttttatataatatgaaaacttggacacaactcctgagcacaacaggaaaataagtaagcaaacttacctgtgtgttttccctcaaaggcaaattccactgaaacaacccaagagttacaaggaaggggaaaagcctgtggcagcattggaaaacagagaacaatatcatcaagtgaccgatagcacagacggatttctgaacgaaatgaagatgatggaatcagatcaacagggaagcagatggtgcccaacagcctagtgatgtaacactggcaaggtacggggctccatgagaggtgaatgggctgctccaaccaagccctagaaactacccaaaggcagagcagccggggctgggataacaggcaggtgtgaggcaggcagaggagggccagaaaagccctcccattacaaccaggtacacggtttacttctcagagctctccacgtcctagtcaaagaagtaagggtagccaaaagtagaaatatcagaaagactccaaattgccattatttgcaaataaaattgtctccttagaaaaatcccaaagaatcaactaaagagtgatttaaaaacagtttggccgggcccggatttggctcatgcctgtaatcccagcactttgtgagcctgaggcgggtggatcacctgaggtcaggagttcgagaccagcctaacatggtgaaaccccatctctactaaaagtgcaaaaattagctgggcatggtggtgggtccctgtagtcccagctactcgggagggtgaggcaggagaattgctggaacccgggaggcggaggttgcagtgagcagagatcacaccactgcactccagcgtgggcgacagagtgagactccgtctccaaaaaaacaaaaccacagttcagtaaaatggccagataagataaacattcaaaaccaccaactgttctaagtgcaaactctaaacagtcgggggaaaaaacggtattttcacacagtagcaacaaaagcataataacaggtcaggcgcagtggctcacgccccaacactttcagaggctaaggcaggaggatcacttgaagccaggagtttgaaatcagcttggtcaacatagctagatcccatctctacaaaagaaaaattaaaaaatgagccgggcatagtggcttgcacctgtagtcccagctacgcaggaggctgaggcagaggacggcttgaacccaaaagttcaaggctgcagcaacctatgactgcatcactgccctccagcctgggcaacacagtgagacccccccaaaataaataaacaaataaaaatgcagctggaagtaagtctttataaattaagacccctttgaagaaaattataaaaccttgctgcagagtgtttttaaaaatctcagcattgccaggcgcggtggctcatgcctgtaatcccagcactttgggaggctgaggcaggtggatcacctgaagtcaggagtttgagaccagcctgaccaacatggagaaaccccatctctactaaaaatacaaaattagctgggcgtggtggcgcatgcctgtaatcccagttactcaggaggctgaggcaggagaatcgcttgaacccgggaggcggaggttgcggtgagccaagatcacaccattgcacaccagtctgggcagtaagagcaaaactctgtctcaaaaaaaaaaaataaagtaaaataaaaattaaaaaataaatcgcagcaagcggagtagaaaggaaatctataaagatatcaatgctcccaaacttaacctgtatgtttaaattaaaaccccaaagagtttcttctggaaatctgaaaaattgatacttaagaattatctgaaaggatacaatcgataatttttttttgagacagtcttgctcttttgcccaggctggagtgcaatggcgtgatcttggctcactgcaagctctgcctcccaggttcacgccattctcctgcctcagcctcccgagtagctgggactacaggcacctgccaccgcacccggctaattttttttatttttagtagagacggggtttcaccgtgttagccaggatggtctccatctcctgacctcgtgatccacctgcctcagcctctcagagtgctgggattacaggcgtgagccaccgcaccccgcctattttgtttttttctttttgagatggagtctcactctgttgctaggctggagtgcagtggcacgatctcggctcactgcaacctccgcctcccaggttcaaatgattctcctgcctcagcctcctgagtagctgggactacaggcacccgccaccatgcccagctaatttttgtatttttagtagagatggggtttcaccatgttggctaggatagtctcgatctcttgacctcgtgatctgcctgcctcagcctcccaaagtgctgggattacaggcgtgagccatcatgcccggccacaatctatcattttttaaaaataagaatgaaaacttgccctatcaggcaaaatgtactgcaaatcctaagtaatactgtatttccagattaaaggcactactgcaaagaaaagtgtaaatttatttaataccaaatgtttcctaagtttactttttgcacaatgcacagacacttttgggacaatgtatggttaaaaactaatattctaccaacagctccatgctgctctagatcatcctgaaggaaaaagtaatgcaaaggatgctgggtctccaagtcccaggactggctgatagcctctcccagtggatagcaggtcctaattctcttcttcgagcagattctctgatttcagctgggccttcctgatgctctccaagttcagttgttgatattttcttttaaaaaagccacactgaaacaaaggaaggaaaagtccagttacaggccaaagatagccatctgtttcagaaaaccggcattctggctgttgcctaaatagcccctatattcctctgcttctcatacttactactcccttctcctaacttactctgaatctctcctggagagtccaatccttcaagacctctggtgctcatccctcaatcagaactgactccaccttcctctgaaccctgctctcccgagcagctgaacctttttaacttattttgcaaagcatgataatttcggctgtactggatctaatcttatttatgcaaaaatactcagtatagcctatgatgctgaagacagaaggagatcaagtacagcttcctacatcaagctcatcatctagtaggaaaaagagataattacaacacagtgtgatgactgccatttggaagggtttctagaagggagctcacagcaaacacacagaagccagcacagaggactcaggagtctctagaccgctttcagggaagacagtgagtgaagtgagcagtcatggagggcattcctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatggctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgagctccagcttgggggacaaagaccctggtgtttatttttaaaaaagaggctgggagtggtggttcatgactgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggtggggggaagggaaggttgcagtgagccgagatcgcaccaccgcactcaagcctgggcgaaagagcggaactccgtctcaaaaaaaaaaaagaaaaaaaagcaacacttaagggcagagacgggtagcggacagagaggagaggatcttaaatagcagtagaagagtttgcacattaagacaggggaaggcaaggaaaagatttcaacaggggaacaacagtcacatctgttttaaggccttaccgttaaggcctcttccaagtaagttataaatgctggcctagggttgaccttccaggccctattgaactcacaggtaaccgaacataacagtattaagttctgggccttgagaatagggaggtaccaaagaaatatatataaaatcactctttataactcagagttttctcttttcagacagatactgttttactcatttgtctaaatgggggtgtgcagttgaaggaggagaaaaaagtggccacgaggccagggcagctgctctaagtcagaggttggctgtcctaaggagttctgtgcccaaaactagagcccagtcttccctcactgtgatgccatgagtagaactgaccttgaacaggatgaccagaatcacgatcaacaccagaagtccaccaacgctgcctttaatgatgataggcaaagaatggtacttctcatctttcaggaagacgacagtgatctagacaagacaaagagatcgcccaataaatcaggtgaagcaaacaaggaaaaaatcctacatgttattttaaggagcaaaatacgaggacttggcaacaacccgtgtattgatcaaagctgatgacagtaaagcaaaaagctagatattccctgatgcagcattttagatcatctaaaactatccaatcacccaaatacttcgtaagaaactattctggccccttatctagaagggctaggtctgtcaggagattatgaccttctgttaaagatgctctgacagcttgaaagagggtcccacggaatccggtctcaacacaggactgtgaggctgtcacgccgctacactgctctatgtccctgagccccgtgcctatgctctttaaaatgatgacttcctttaaatgatctccaagtcctttccaactccgttctgacggctctttttgatcttgcacagatccctaaaggctttggtaatacactttccccacataaaatatgacaaaagtactggtcttcccctcaccagactaaaaagtgtgtattacctaagggacataataaatgcaaattatatccatgtgtactacttgcagagctcagctattagaagtcatccgcaggttttgttttccaaaggctctcccaatttcgggagtctaatctctcttctggcagggctcagctagaaagttcaggagatgtccttcctgagacccaggtatggcccttccaagttgtggccagaggaagttcccaggacttaggtggggccagagagccaacaagacttctctgcctgcccagagcaacccttcacgtgtatgtttaagcaccaaggtcaggggtgctttggagaggtttctgtacggggtgaagggctggacaaacttacctttaaggcctcttccaattaagttataaatgctggttgacctaaagttgaccttccagtcctatttagctcataggtagctgaactaaataggagtgaagtcctaggctttgagaatagggaggtaccatagcaacaaagagggaggaagaacagaaagagggctggaatattctacaggagaaggagggggactcaagaccctgggtttgggaagtgaaaggaagtcccaaggtgactcgggaaacaggccagatgtgagtagaagaaatgtccctatttctcaaagccacctccctttatcttcttctaaacccacagattcccaaaagtgccccaaagatgcccaagtagaggttaagggagaagcaaggcaccgggtactactgtttgcagcaaacacggatgctggcctgcccaggggcccctctctccttttggattttattcaggaatcatcgttggtctcaggtgatcatgacacagctattctcctttgccagtgactgacatgagattcagatctcactaataagatgtaagaggatgtctcctgggagcttttggaaactgtttcatccctgaaaagggaaggcacatgaagaaaaatccaacatccttttgctactgacttcttgcttcctgttttgtatcctgccatgtgaaaatacagcatttggagatgtggcaactttgtgctggccatgaaggaatgcgtcccccacacggcagagtacaaggaccaaagaagccaggccatcgccccaggccggcctccctcactggataaacagcatatgcccttatgctgcatgagctggattttccctttcttgtggctgaaatgcatttggatacagtttgtttatactcatagagtcactgtaagtcaggggcttattgtcaggaactacttaacactttgcttaggatattggatttaaagaaaggaattttggggaatccatgctatagaaataaaagtatcagtaagtaagagggggaaacatacaaatttaaaatgtgcacataagaaacttaatagtaactcctccctgctgggggcatgggaagggagaaatgaaggaacaattatttttcatttggtaccattctctgtatggcttggattttcttgctattatttttatttgttaaaatctgggcagtgcaataatggggcacttctatttcttccgttttctgtattttccatttccctctattttctgtattagaaatacactacttagccggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggcgacacagtgagattcttcctcaaaaaaaaaaaaaaaaaaaaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacacaaagcattcagtccacaaatcacaggcatcagtctgacttctagtcatacttttgcaaaaagaattccaagagttccagtatctagtctaaatcttataaaagatttatgcattcctgagtactgtttaatactataactaaacactgatacagcacactaagacagttactggatacaaaaaacaatttctcacttaggtaattcattttttatttatttatttattttttgagactgagtctcactctatcactgaggctggagtggagtggtgtgatctcggctcactgcaacctctgcctcccagattcaagcgattctcgtgcctcagcctcccaagtaggtgggattacaggcacccaccatcatgtccggctaatttttgtatttttggtagacagggtttctccatgttggccaggcttgtgttgaacttctgacctcaggtgatccacctgtctcggcctcccaaagtgctaggattacaggcgtgagccacctgcgcccagctgcgaaatttttttttttaatcaatccattttcaaatcaaagtatatactgcagattccagcctagttatttcaactcagaactcctcagcttaggcctcttaattgccttatttcataagaagctgactcactcaaaggtcacaaaggcagcgatggcagagccaagatcagaagtgttaaggctgaaaacaggaagagggcaacagaatgtctgtggaggtgctcaaaggttaggcacaattttccttgggcactactcagaagccagccaggaattaccttagttctgtggttctctgcattcagtccctcatatagagatttgttgaaagatatttcaccaaggatctgcagttcagttacatcttttagtaactagaagatggggaaaggaatgagggaaacaaaacatattttagacatgaactcactgtgtttgaacagccttcaccacctttccctttaaaggtattcctgggcttagttaatggccctaacgtacacaacactacataaagttacccaaacaagacatctgcagttattcttcaacttcctttttttttttttttgagatggagtttcgctctttcgcccaggctggagtgaagtggtgcgatctcggctcactgcaacctccaccccgtcaggttcaagcgattctcctgccttagcctcccgagtagctggaattatgggcatgtgccaccatgccaggctaatttttgtatttttagtagagatggggttttgccatgttggccaggcttgtctcgaactcctgacctcagatgatctacccacctcggcctcccaaagtgctgggattacaggcgtgagctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagcaatccacccaccttagcctcccacagtgctgagattacaggcatgagccaccacacccagcttattcattttatttaacgtaagagatttttcctttttttttttttttttttttttttttttgagacaaggtctcactctgttactcgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatggggtttcactatgctgcccaggctgatcttgaactcctggcctcaagcaatcctcccgcctcagcctcccaaagtgttgggatgacagatgtgagccaccacactcacaattctttttttttaaattatttcttgtatctgtccctttcttttccacccccattgctacttcttcagttgagacctcacaaatgtcacctggatcactgtaaaacattaaacttgatcacttgatcactagttcccactttagaataagtgatcagggaaggcctctctaagaaaataacacgtgtggccgggtgtggtggctcatgcctgtaatcccagcacttcgggaggctgaggtgggtagatcatctgaggtcaggagttcaagaccagcctgaccaacacgatgaaaccccatctctactaaaaatacaaaattagccgggcgtggtggctcacgcctgtaatcccagcactttgggaggccaaggagggcggatcacctgaggtcaggagttcaagaccagcctcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagcgaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcctggccaacatggtgaaaccccctctctactaaaaatacaaaaattagctgggcgtggtcgccggcgcctgtaatcccagctactcgggaggctgaggcaggagaatcacttgaacccgggaggcggaggttgcagtgagtagagatcgtgccactgcactccagcccgggtgacagagcaagactccatctaaaaaaaaaaaaaaaaaaaagaaaagaacacctgagctaaatttaagaagaaaccacctacgtcaggacctagaggaagagcagtgtcaagcaaaggaacagcaagtacaaagtcttgtggccagaataatgctgtactggcgagctagaagaataggacagaataacccgattataaaaggggcagtgggagagaaaggcgagtactaggagatgaagttgaagaattaagcagagaccagatcaagtactgccttgctctggccatgaaaaaagtatggattttagtctaagtgtgctcaagcatcagttttgtttgtttgttatttttaataagcaggggaatggcacaatctaatgtctgctcttagaagacggatagctgttacgtgggaattatttgtaaagaatgtgggaaaagcagaggcaagaaaggcaggccgaaggttattgcaacagccctggcaagaaagggtagcttgaattacaacggcagtggaaatggagagaagtgaatgggtttaggatatattttggccctgaaatggcagggcttgctgctggaatagacgtggggatgtaggaaagaggagtcacaggtaatccctcgagttccttgtactgtaactggagtatatctccctcctgagggtagctaaggaacgggttgggacagagggttggttttttgcaccaaaagatctattttggacatggacatgttatgcaaagatgctattatctcttctaggggcgatgcccgtgagcaactggataatcaaatctggagcatttcagtctcaaacacctcctcagagtgatcccaggagatctctgcagccacggtgacattttctttatctgaagcgatgacacagctcactgaatgccattcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcgaagctccagcgggagcaattgagacccagggacgaagctagggagggcctggcagcccccggcactggccggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcgctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgggaaagtgttgggatgacaggcatgagccactacactcatccctttttttttttttttttttttttgaggtggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttcagtagagacggggtttcgccatgttagccaggctggtcttgaactcctgacctcaggtgatccacccacctcagcctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatccccgtctctattaaaaattttttaaaaattagctgggcctggtggtgtccacctgtagtctcaactactcgggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttctgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccgtctttcattggaactaggaataagagtgttagttcatagcacacctgctttgtacatagcaagtgcttcttaaaaagggcttcgctctgttgcccaggcaggagtgcagtgttgccgtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcgtgagccactgcgcctggctatttttttaagttccagggtacatgtgcagatgtgcaggtttgttacataggtgaacgtgtgccatggtgctttgctgcagctgtcaacccagcacctagttactaagcccaacacgcattagctattcttcctgaagctctccccaaccctgcccctcccacaggccccagtgtgtgctgttcccctccctgtgtccatgtgctctcactgcagaacaggtgcttctgcacctggctccccagggtcactgggagtcagataagaaaaggctctcagaggctgggcgcggtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactctgtctcaaaaaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagcgttccccaccttaccccccaacacagaggtcttgcaggtaacatagctatcccaagctattccaaagctgagtgaacgagaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtacttacttggtgacagtcacagtgatgtctgctgtcctgtttggaaaggcattctcctctagctgccaaacgactgaaacatgagcctattttaaagggggaaaaatggtcagttgattctctctatgccactcacaattcagaccgctagctactcgtggaacagacctaggagacgattcctcagattttcacattcctcacatttttctaacacagcatgtttcctttcccttccttttttttttttttttttttttttgagagggagtctcgctctgtcacccaggatggagtgcaatggtgtgatctcagctcactgcaacctctgcctcccaggttcaagcaattctcctgcctcagcctcccaagtagctgggattacaggcacgcaccaccacgcccagctaatttttgtattcttagtagagacggggtttcaccatgttggccaggctggtctcgaactcctgacctcaaatgatccacccacctcggtctcccaaagtgctgggattacaggcatgagccaccgcgcctggccccgttatttcagttaagcctcaaatacaaatatggagtaagcaaggcaggcggcctcattccccttttacaggtgaagaagccacttcagagatttcccacagcacagagatgacaagggacagatcagggttaataacttttcgtcttggccgggcatggtggctcatgcctgtcatcccagcactttgggaggtcgaggcaggtggatcacttgaggacaggagtttgagaccagcctggccaacatggtgaaaccccatctctaccaaaaatattttaaaaattagccgggtgtagtgctgcacgcctgtaatcccagctactcaggaggctgaggaaggagaatcacttgaacccgggaggcggaggttgcagtgagctgagactgtgccactgcactccagcctgggtgacagaatgaaactccatctcaaaaacaaacaaacaaaaaaactttttgtctgacacgccctccatactacccacaacttcactctgcttcacggaggtgagcaggcagttcacctagggctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcagtccaaaccgactcacagatgacctcttgaggacggggtgaccaatcctgcagttcatgatcaggacagaagcaaccggctgagggtcatcacactgaatgtttggagagggaggctgttaaaagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgagggagctgcagagaacagcagtggagaaatatgaattccaactcggaggaattcgtaaggtcttcctggggaaggaggcatttgagctgggccatggactgatgcaaatataacccacagcctggctggaaggccggcacacaccagcactgccacgtagccaccagggctccccacctggacccccgaggggcaggtgatgactgcagtgagttttcttaattctcccagggacggtccatccctagttcccctctagatgcctaggagattgttttttgcttttgttttcatttttttgagatggagtttcactctttcgcccaagctgcagtgaagtggcgcgatctcggctcactgcaacctccacctcccgggttcaagcaattctcctgcctcagtctcccaagtagctgggattataggtgcccaccaccacgcccggctaattttttgtatttttaatagaaacagggtttcaccatgttagccaggctggtctcgaactcctgacctcaagtgatccacccacttcagcctcccaaagtgatgggattacagccgtgagccacggtgcccggcctaggagattgcttcattcatataatggatactgtcctagcccaaatagcctaagatgaccggggacaaatctacagtccaacaaattcaaatttattgactcactgcaatgaggaaaactacactttggttttgtttgtttgtttgtttgtttttgagacagagtcctgctctgttgcccaggctggagtgcagtggcgcaatctcagctcactccaatctccacctccgggttcaagtgattctcgtgcctcagcctcccgagtagctgggattacaggtgtacatcaccacacctggctaatttttgtatttttagtagagacggggttttgccatgttggccaggctggtctcgaactcctgacctcaggtgatccgcccgcctcggcctcccaaagtgctgggattacaggcatgggccactgcacccatccaaaaactacactattgtgtgtatcactgaacaatggaaaaggcggttattaaaggactccagggaagggtggagttcagatgaaatgtaaataaagtcctgttttgatggtaaagcagggctgagtgtcaaggagtcagtcaccagcaggccagcctgtgaatcagacccagggcccgcttcctgggaaaccattaatatggagtagaaagttgacagacactgtatctgaagctctctacctcaggtggaaacagactcttctcttggtcaaaatgacttacactctccaggcaagagggataggggttcataattaccgacgtaactacttcaaacagcaaagttttctttcttgttttttcttttgagacagactcttgctctgtggcccaggctggagtgcagtggcgcaatctcggctcactgcaagctccgcctcccgggttcacgccattctcctgcctcagcctcccgagtagctgggactacaggcacccgccatcgcgcccagctaatttttttttgtatttttagtagagacggggtttcaccgtgttagccaggatggtctcgatctcctgacctcgtgatccgcccgtctcggcctcccaaagtgctgggattacaggtgtgagccaccgttcccggcccaaagttttctgatctgtgattttagagaataaaatttctcagtgcagtgatacttgtcagccacagggtgtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggcactgcagcagaatatggtgcctcgggaggcatggagccggactggcggggatttatctagttattaaccatctgttggttggaccaggaggaggctggaggcaggggtgccagtgagggggccaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacagggtacagataaaaatgttacagtttatttcatctgtaaaaacctcaacgcaatacaataggacattcaccgaggctagagcgtggtgctgtggtgcaatgatcacggctcaccgcagcctccacttcctgggttcaagtgatcctcccacctcagcctcccgagtagctgggactacaggtgtttaccaccatgcccagctaatatttttcttatttttatttttttgagacggagtttcgttcttgttgcccaggctggagtgcaatggcacgatctcggctcactgcaacctccacctcccaggttcaagcaattctcccgtctcagcctcctgagtagctgggattacaggcacgcgccaccatgcctggctaattttgtatttttattagggacggggtttctccacgttggtcaggctggtctcgaactcctgacctcaggtgatccgcctgcctcggcctcccaaagtgctgggattacaggcgtgagccacccagcctggccaatgtgcagctaatttttgtattttttgtagagacagggtctcgccatgtggaggcgggtcttgaactcctgggctcaagtgatccacctgccttggcctcccacagtgctgggattacaggtgtaagccaccgcacacagcccagaatagcaccttcttaagtaacttcttagataagttgcctaaggaatacgtttagcttagacattcttcctctcaacataagcaaacagctggactgccacgcccatctcagttgttgcatgagatgacgataatagctgccctttatttagtgcttaccatgtgccaaggactgcgtctcacacgctcaaccctcatagtaaccctgtgaaatagtacagctactctccattttatagaagaggaaacagaagccaagacaggctaattacctgtcatcccaacactttgggaggccgaggcgggtagatcacctgaggtcaggagttcaagaccagcctggccaagatggtgaaaccccgtctctactaaaaatacaaaaagtagccgggtgtggtggcaggtgcctgtaatcccagctactcgggaggctgagacagagaattgcttgaacccggtagggggagtttgcagagggctgagatcacgccactatactccagcctgggtgacagcatgagactccatctcaaaaaaagaaaaaaaaaattagccaggtgtggtgcaggcacttgtaatcccagctattcaggaggctgaggcaggagaattgcttgagcccgggaggcagaggttgcagtgagccatgagcacactattgcactccagcctgggcaacaagagtgaaactctgtctcaaaataaataaataaataaataaaaggctaattaaatgcctggagtctagtagtccaaagaattgagagaattgtacccaaatcctctttctaccaccaattcactgtgaccctaggtgaggtactctatgacacaaattcatccatgccacaatatttatggggcactgctgtgcactggagaacagtgtgcataagacatactgtcctaccccgtttcttggcctcagcttcctacccacaaaatcattcagacccttcccattaaaaggctgtggtttaagacatgggtccacatgtcctggaaaagagggtcctggggatgtgtgaaagggtcctccagaatgctgaggtatcacagggacccagagtgcagaaccactctcagtagctgagattgacagaaaaacatattagcaataccgagaaaactgttttccatctgaaatgtccaaagatgagatgtgcagatctaggaagtatggcctcccaaagtgctgggattacaggcgtgagccaccacgcccggcctaggaagtaatgtgaggtgtgttttgttcccattgtttggttttggtttggtttttatcccagctgagaagaggctggattgactggagggagagacaggaagcagagacagagcctgctgtctccacccgagagatgatacatgcctgaaataaggaaacagtagtggatgcctggacacggtggctcacgcctgtaatcccagcactttgggaggtgaggcaggtggatcacttgaggccaagagttcaagaccagcctggccaacatggtaaaaccccgtctctactaaaaatacaaaaattagctgagtgtggtcacgtgcgcctgtgatcccagctacacaggaggctgaggcaggagaagcacttgaagccgggaggcggaggttgcagtgagccaagatcgcgccactgcactcctgcctgggtgacagagtgagaccctgtctcaaaagaagaagaagaagaaaaaagacaacagtagtggagaaggaaagaagtcagagacagtaaagcaaatgaaacgaaaaagaggcaggggaggggggacagaggagttaagggcaagttctgagtttctagctcaggtggctgagtggtgccggtggctgagtggtgccggtggctgagtggtgccattgactgagggaggtaacatgggaggaagacccaagggtggaagaagatgcgttcaatcggggacatgacaagaggtgcatataggataacaaagcagagatgctgacatgtcagctggacacacatcttagagctcaggcgtgagacctcagtgtcatcagaatattaacagcgttgcctaatctgaggcctagggaccgtctcagagggcccggaatgccaaaatttatgtatgcacatgtgatcttctaaggagaggggtctgtagtcttcattagattcttttggggatctatgtcctcaggtcaaaaaccactgagacagctggacaccgacgaccaggctcactagcgtttttgaaagagaagcgtttgcttgctatgtacactagggggcgatgtagggcaagccatgcgtgctgtatctctactacccccagtagctggctgggaggttggttcttggctgtaattaattccctgctggaaacagctgtgcctgcttgttagcctggattccagagcatttgaaagtcttcaattggtcctgcaaatgtctatgaaagggctgaccaggacttggggaactgcgttcttccccatatacggcaactccagccagctggccaacagaatcacaatacatacacaacactagtcgccaaggacgcttgtttgttttgttttgttaccctccccccctccccgtttttggagtcttgctctgtcacccaggctggagtgcagtggagcgatctcggctcactgcaccctccgcctcccgagtttgagcgattctcctgcctcagcctgcccagtagctgtgattacaggcgcccaccaccatgcccagctaatttttgtatttttagtagagacggggttttaccatgttgaccaggcttgtctcaaactcctgacctcatgatccgcctacctctgcctcccaaagtgctgggattacaggcatgagccaccgcgcccggcctggggggcattctaagaccactacatgtctaaacccacactcatgtgcttggcaacactgtcattctggaattcagtgtggtccaatagaacgtctgcagcgatggagacaggcggtatctgcgctgcccaacaccaccagccacaggcggccactgagtctttgaagtgtggctaatgtgactgaggaacaaaatgtttcattgtgattaattttaactcatgtacatgtaaacagctaagcgtggctggtgtgttggacagtgcagtgccgcatgctggggctgtggccctctttcctccctccgcctccattctgtcagcacgtgctacgtatgagctgtcactttaaactgttactcccgtcatggcccagcccacaccgcctctcacctgagtggttacaaagggagcaagtgccgcttctcttctcagctaagcagcaagaaggatcctgctaagctgcatgagtgtgtcactcctctgacttcccagctcacagcaaaagcccttctgagggcttaagaagccccatggcctcttcccccttcctccccttccctcattacaccccgccccactccactgcagccactagctcctcaccctgccccccacccaccaggcaggcttccaacccagggtacctgcagctgctcttcccttagacacccaaccacatagctcgttcccctacctcctccagtgtgtgccaaagtgtcaccctccgtgaccaccccattgaaaacttcagcatcagctgccacccaacactccttcccaccttccctgtgtcttcaacgttcatctcatcaacatggaatttacctacttaccatcttctccccctaagagcaccaggagggcagggatttttgtctgtgttgttcacagaagtatccccagcacctagagtgcttggcacaaagtagatggtccagaaatatttgattgattagttaatttggccaagaggtgggccgggaaagaggttacctctaactgaggtagaggtcagcctggctgtgaagaacgctgggttctgaatatagcattgtccgggatgtcaagagacccaggttcaagtccaccaaatggcctatgcagggccctcggcgactgagtctgcttcctaatctagaaagtgggaagacagatctctgtcttgcctcccttctggggtagctgaggacatattgagataataagtgcagaagccatttgtgggccacggggagaggggaaggggatgtgcagggtgtcctaatgaaggaattgcccaggcaagcgttcgggagaaggttaatcgaggaaactgacggctatgtccaactcactgagagacggtggtggccaactgtaattctgcgacacaaaacagcttattcttgcaggccttctcatagggcagctgtaaccagacagagagtcccgatcagcccaggctccgccttccccagcagccctgcctccggctcttctccttataggaagttttgggctgtgcctcctgctcaccctgagaagtgcagttacagggaggtgaggggtgcaggctgggattgtccccgaagagcagggactgtgacattcctgggtgacattcctggatctgtcctataacatgggcacactgtgacccagtcctttgaccaaggtaaaaactggggtgaccttcacggaatgttaggggtgcccatgacatttacatcatgcgaattcagcagcaacacacagctcacgactttgagcattcagggagcagacacctacgcgaagagaagcttccttagtcctttcggatataggcagaacagcccgggcaggagtgggggatgcctagccaaatatcgtcaaggtccaggccttggaggttccttcctcatggctagtcatctgttttttcggttgtttgtttgtttgttttcagatggagtctcgctctgtcatccaggctggagtgcaatggcgcgatctcggctcactgccatctctgcctcccggattcaagcgattctcctgcctcagcctcccaagtagctgggattacaggcatgtgccaccacgcctggctaactttgtatttttattagagaaagggtttcgccatgttgaccaggttggtctcaaactcctgacctcaggtcatccacccaccttggccttccaaagtgttgggattacaggtgtgagccaccgcgcccggcctggctagtcgtctctgtaagctaactatttcccttgcctacacataatcgactaattctgaaagccacatttcaaaaggccccatggaggttgaaaagctccagttcgtgtttttaaaaattccagtgttctaaagtagctgggtctgtttttgtattatgaaggaaggcagccagctcctcggctggagagcctctgcacttcgcacttctctcccggtggccacctcggcagctgtctgcaggtctgttcccacggcctagagggggaatgacagcccagggcttgaaagggaactttctacttcctgcggaagggggatgccatttgcagaagtcaaagcgtggcgctctctctaagtgggtcaacagtttcatgcagggttttttgttgtatttttttttttttttttttttttttgagacggagtctcgctctgtcgcccaggctggagtgcagtggcgcaatctccgctcactgcaagctccgcctcccgggttcacgccattctcctgcctcagactcccgagtagctgggactacagctgcccgccaccacgcccagctaattttttttttttttttgtatttttagtagagacggggtttcactgtgttagccaggatggtctcgatctcctgacctcatgatccgccagcctcggcctcccaaagtgctgggattacaggcgtgagcccccgcgcccggccttttgttgtatttttaatatagccacatagcctgatctcttccacccagccccagtgaaagagaatggggttaagccatctaaactcccagccagaacgcactctctggtaacaccgatgtgcctaataccacgtggttttttcctcacccattttatacggggaataactttttaaaaatctctttgccatagcataatagtcatcactggttaaggaaagacacataaagagatgttaagcaggatacaatcgcaaggcatctcaccataaaatgagacgtgcttattaatgacacaggcaaacagcactaggaatggacaagtccacattaggtgcctcctgagatggtgtactgagaaggacacactttacttctgtgatattcctgacaaaaatgcataacctggccaggcatggtggctcacgtctgtaatcccagcactttgggaggccgaggagggtagatcacctgaggtcaggtgttcaagaccagcctggccaacatagtgaaaccccgtctctactaaaagtacaaaaattagccgagcatggtgatacatgcctgtaatcccagctactcgggaggctgaggcaggagaattgcttgaacttgggaggcagaggttgcagtgagccgagatcacgccattgcactccagcctgggcaacaagggcgaaactctgtctcaaaaacaaaacaaaaatgtataacctgaatctaattatgaagaaatatcagacaaattgaggaacattctacaaaaggactggcctgtacccttcaaaaatgttaatgtcattaaaagacaagggaagactgagtgagaaacccttccagattaaaggagactaaagataaataactgtagaacgctatgaatgatcctggaccagaaccttttttttcttttgctataaaggacattaataggacaactggcaaaatttgaataaagtttgtaaattagataatagtattttatcaatgtgaatttcctgattttgattattgtactatgttaagacaatgcctttgtttttaggaaatatatattgaaggtttgtggttttttttttttttttgagacggagtctttctctgtcactcaggctggagtgcagtggcacgatctcggttcactgcaaccactgtctcccggggtcaagcaattctcctgcctcagcctcctgagtagctggaactacaggcatgcaccaccacactgggctaatctttgtattttttaaaatttattttattttttatttttttgagatggagtctcgctctgttgcctaggctggagtgcaatggcacggccttggctcactggaacctctgcctcctgggcaaaggattcaaatgattctcctgcctcagcctccctagtagctgggactacaggcccatgccaccacacccggccaatttttgtatttttagtagagacagggtttcaccatcttggccaggctggtatcgaactcctgacctcaggtgatccacctgcctcaacctcccaaagtgttgggattacaggcatcagccagggcgcccggctgacaaaagtttcttatgacactacccgcctgtctaagctgcactgatgggcaccaggaggagaggctaggatacaggtttggtggggccattcagcctgaaggccctggcagggcatgaacaggcaggtgtgccaaagggcatcctctctgcagtgcaagacacgacagctccagtctagctcccacaaggaacccccatcacagcgtcatcagagccgcttgccaagtgaggtccccaggatgcaatgtatgcatgtgcctcatgaaagatgtagcaagtgcttttgtgaacataaagacataaaggaacaagccccaggggcagatggagacctgcgttacccatgagtcctcactcacggggacacattaacaccatctcagggactcagtttcaccatgagtacggtgaggggcccaaatgccgtctgaagacattgcctcccaactccaccattcttggaagttaggggagcaggtggtttctgtgggataggctcttaagagggctgggtactggctgtgggtagagtcacctggaagatggcaaagggctcagtgtagcggtccaggatgggctggggatggtccgtctgtccctcaggggtctggagctggtagctgactttgacactggcattggagaagcagtcctcctcacagagctgtggggtcaccacggaaggcagggttagagttggatgtgggggagaagatgacaacaataatgctttttttctttttctttttttctttttttttttttttgagatggagtcttgctctgttgcccaggctggagtgcagtggcgtgatctcggctcactgcaacctccgcctcccgggttcaagcgattctcctacctcagccgcccgagtagctgggatgacaggtgtgtgctaccacgcctggctaatttttgtatttttagtagagacagggtttcgccatgttggtcaggctggtctcgaactcctgacctcaagtgatccacccgcctcagcctcccaaaatgctgggattataggcgtaagccaccgcgcccggcctcttttctttttttttttttttaagataaggtctcactcactctgtcacccagtctggagggcagcagcaccatgatggctcactgcagcctcaaccacctgggctcaagcaattcacccaccttggcctcccaaagtgctgggatttccaaatatgagccaccgcaccttgcaagaatactttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctcttttttttttttttttttgagatggagtctcgctctgtcgcccaggctggagtgcagtggctcgatcttggctctctgcaacctctgcctcttaggttcaaggttctcctgcctcagtctcccaagtagctgggactacaggtgcatgccaccacgcctggctaatttttgtatttttttttagtagagacagggttttaccacattggtcaggccggtctcgaactcctgacttcaggtgatcctcccacctcggcctcccaaagtgctgggattagaggcgtgagccactgcgcccaaccaaccaagatctttctcaaagcaacatggaggacatattagagaggtaagagagaagataaggagattgcttagcataccatttgccactctctttgtttaaataagcctttctgcccctataagagcctcaagcccatgggagaaagtgagcatgattctctggtagagaatgtgattaagcctttatttaaggaaggctgtagactttaatccaattaacaatcactttgggggtaaatgtgtattcagaagaagaattcatgcatttgtttattggaataaacgatccatatagatccaaagttcgagatcctgtcagggtttgagtcccgacatactttttttaccccatgtctctgggcacctttgccaggagtaaacctttctagatggtcgtttctatctttttattcttccttttagttgttcacttttttgatgccaactgacattcaggccctcggtcctagttattatcaggtgaggtctgataacgcatgccaagaacactggcattcctgagttattaccaagaaaaacgtcagcaatgacagcatctccatcttccgtgccattacgtggttcttgatttattattattattattttgagatggagtcttgctcttgttggccaggctggagtacagtggcatgatttcggctcactgcaacctccctcccctggattccagcgattctcctgcctcagcctcccgagtagctgggattacaggcacccgccatcacgcccggctaatttttgtgtttttagtggagacagggtttcaccgtgttggcccggctggtctcgaactcctgacctcaagtgatccccccgccttggcctcccaaagtgctgggatgacaggcgtgagccaccgtgcctggcctgttatgattattttaatcacctcatttgtaggtctgggtatgtgcccttcactgcatcacctcaaatcctttctcaatgacaaagacccctcctgactcccatccaaactccgtcacttacctctccctctgtgggcatgagcaggaggtcctcacaaagctgggatccgctgctccactccctcaggcagcccagacagcttcttacgtctgaacactgcagccgtctcctctgcttccccacatccacatccagcgtgaagttgagaagtgcctcgcggaggcctgggaatgaagaccagaccttcccgatgaggtggggatgagccagccgcagacagaaggcccccagcctgcctgaggttccttgtggcccctcctgaacagtgtccccatgcaggtacttccctgcggctggactcctgcgtcggtttttcaaagatatttttctcaccgtcttctgacacctgaccagggtctctgagtgctcccgccccaaacccggagcagcacattcccaggactgagtcagccttctttagggaaggagggctcgggaaggggatcgagattgaagaagaaaataaggaggaagagagacaacaaagagaatggagagggaaagagggactctgcggagaaaaaccccaggacggcacagctggaagcaccgtggagatcccggggccgcctctcttactgtacagaacagaaccagctcagctagggagagacacttgcccagcatcgcacagcccatcgagctctgtgtcctggaagggacaggtctgttattttcttttttttttcttttttctttttttttttcctttgagacagagtctcgctgtcacccaggctggagtgcagcggcgcgatcttggctcactgcaagctccgcctcccgggttcacaccattctcctgcctcagcctcccccgtagctgggactacaggcgcccgccaccacacctggctaattttttgtattttgtttagtggagacggcgtttcaccatgttagccaggatggtctcgatctcctgaccttgtgatccacccgcctcggcctcccaaagtgctgggactacaggcatctgtcaccacacctggctaatttttgtatttttagtagagacggggtttcaccgtgttagccaggatggtctcgatctcctgacctcgtgatctgcccacctcggcctcccaaagtgctgggattacaggcgtgagctaccacacccggccaggtctgtcattttcaatccccaggtggataatagcctgctgctttgggaaagccaccccaccccaggagactgctctctgactgtgggaggcagagaccatctcagagattgctcctgagagattaaacctcggggactgttgctgaggaatcgttccaggggggagctcttggatgagcagtaaatacctgggctgtgaaagccatgcccaccacctcctttctgggaacagtctcctaatgagtttcaggtaaggaaagagaaaccaggcctccaacaggtgatccaatcccacctgggccggaggcacatagtgaggagggaaggggagaagacacaagtcagagagaaagaggagggtgtgtctcagaagcccccgcacacacgcacacacgtgggcatggagaaatggctgcctttttctgagtcttttttttttttctgagacggagtctcgctctgtcacccagcgtggagtgcagtggtgcgatctcagctcactgcaagctccgtctcctgggttcatgctattctcctgcctcagcctcccgagtagctgggattacaggcacctgcccggctaattttttgtatttttagtagagacggtgtttcaccatgttaggcaggatggtctcgatctcctgaccgcgtgatctgcccgccttggcctcccaaagtgctgggattacaggcgtgagccaccgcgcccggccttctgagtcttttttttcagaaactcaacccttcaaccctgaggaagggccccagtgtccctcttcccaacagtgtcagctctaaaccccttctgagtgtggacataacctcagaccaccctttcttgaggcagtttgcatttaacaaacctggagactaaggagctaagctctaatcgagggatttcaagcaccaggacctcagaccaacacccacccaccccccgccccagtcctctttccctgccccttacagaagccaaaaaggaaagaccatcacaccaggcaggggtcagctggaccatttttttacctgactcagaggctgtggttacagagctgatttcaaaacataaacggacattcacgacgccgttgaagccgatgggcagtgcgctgggggtgaaggccatggagaccttcaggcgaaccacaggccgggagctaaacaagacagcaaagaggatgggagaagtgactgctcagcctctgggtcagggcctggctgattggttcatgcattcaatggttctctatcaaacatgcccacatccaggtgatccctgagtctcagggtacagtggggaaagagacaagtttctgctttggtgggaaagcagacaacaagcaaataaacgagagaaacagggagatactatgtattggcaaggctatgagaaaaattaaaatactgttggccgagtgcggtggctcacgcctgtaatcccagcacttgggaggccgaggcgggaggatcacctgaggtcaggggttcgagaccagcctggccaacttggtgaaacatcgtctctactaaaaaactcaaaaattagctgggtgtggtggcgggcgcctgtaatcccacctacttgggaggctgaggcaggagaattgcttaaacctgggaggcggaggttgcagtgagccgacatcctgccacggcactccagcctgggtgacagagcaagactccatctcaacaacaacaacaaaaatacggtaataaggaccgagggctactgagactgggtggtcacagatggcgtggctgatgaggaggcatttcggttgagatttgttaacaagaaagagccagctgtgtgaggatctggggaagagcactccaggaagaaagcacagccagtgccaagggcctgtggcaggaacacttttggtttgtttgaggagcacaaaggtcagcatgcctggaatctaattagtgagacagaggatgggaggaggagatgggaatggaggggcgggaagggccaggccacgaagagccctgtaaagccatggtgaggaattgggattttactctaaataggagccgtggaggagtttcaggcagcagagtgaagggatagggctgctgctgtgtggagaatggagcgcaggggctggaagcaggaaaggctgtggcagcagtgtccagggagtgaagacagtgcctgcactggtctggaggcagagccaactaagacttgttgatgtggtggagaggaaggaaaagaggcatcaaagatgacgcctacgttttcatcctgaattgctgggtggatgatgatgccatttgctgagacagaaagcctgagggcaggatagatttgggggaatgaagggtggggggagataaaagctctgtttttctttttttttttttggagacggagtctcgctctgtcgcccaggctggagtgcagtggcgcgatctccgctcactgcaagctccgcctcccgggttcaccattctcctgcctcagcctcccgagtcgctgggactataggcgcccgccaccatgcccggctaattttttgtatttttagtagagatgaggtttcaccgtgttagccaggatggtctccatctcctgaccttgtgatccacccgcctgggcctcccaaagtgctgggattacaggtgtgagccactgcgcccagcaaaagctctgtttttagacgtgttcacttcgggatgactgtgagcagcagctcagggaggtgctgggtagacagcaagtctgcagcttggagaggacgggacagacgggcgctccatgagctcatttacagccacgggacttgatcattcactgagggatggggcacaaaaactctgcaattcttggccaggcatagtggctcatgcctgtaatcccagcactttgggaagccaagatgggtggatcacgaggtcaggagttcaagaccagcctggccaacatggtgaaaccctgtctctactaaaaatacaaaaattagccgggcgtggtggcagacacctgtaatcccagctcctcaggaggctgaggcagaagaattgcttgaacctgggaggcggaggttgcagtgaaccaagattacaccactgcactccagcctgggcaaaagaggaagactccgcctcagaaaaaaaacaaaaaacaaaaaactctgcaatcacagccatcgctgagcactgtgctaaatactttgtatatattcgcttgcatgatcctcatagctctgggaggtaggtgctcttataattcctaggtaaggtcttagagttaaataacctgcccaaaggctgagagggctgagagctgaggttcaaacccagacgggcagactccagagcctgtgcccacaaccacggtgctggctccctccctcagtgcctaatgtctgcatggagctatttagagcagggcaaatgggtgaggctgggcctgggaccccagaaagcaggacagaaccctaccggaacacaaccgcctggcccagagtgcccacggtgatgtcggcaaggccgtcgccactaatatcaaagccaccagccatggacatgccgaagtactggagtcctggggccaccgtggaggctctgatccgctgtggaggcagaaacacaaggcgtggggcgagggaagggagggaaacggggcggggagtcctttcatgatctatcccgatcagcatcgcaggcaccatccagccccagggagccccgagtctagaaccaggaaagagggagcaagctttcccagaggaagtggcatttggatggagcctcgaagggcaggtgggacttgacaggggagagtaagggaaagagtgaggcatggggaaagagcagggccttctgagaagcagccagggccagggacggggtggaccacaggggattggggtacaaggaggcttgatgtggggcttggggatggggggtgtcaacaaaggttctgttgttttgaagtgacataatcaggataacactttagaaatggcactgaagacatggggtggaagatggagaggaggaggaagctgggtgggctgggagtgggatggcaaggcctgagctgggaccgcaggggtggggatagagagaaggggctggagttgggagacagctagaatcatgaggacgtgggaactgacaggctgtgcaggctgtgagcgtgctgaggactgtctgaggtttccggtgtggggtgtggagggggatgaggtctcagaggagcatcagttctaggggaagcaggtgctctcagatgggccgtgtgggagtgagatgcctgggggccatccaggtggaggtgctcatgaggagctggaggtgggtggaagtgcctgttaatacatgcagtgtgagaggctggcaagggagccctggggaatgagagataaggcgcggaggtgctgggtgggagacaggagcgagggacagaaagagaggaagcagggacccgaggcaggtgggtggaaggagggggtataggccagggaaggagacaggtaccgccacaacctcccctgaacctgaaggggccgaggtgaagccctggtctggaacctccccccaacctgaaggggctgaggtgaggccctggtctggaagctccccctagcctgggggacttctttctttcactgggcattcccaacccccgagacctgcccagcacttaggactgaagccgacttggggcttgggtcatcatatctgagagaggtcagagccccagaggagaggaaggagagggccccatgggtcacctgcgaggggctggcggagaggccgtcccagtgtccattgtagatatacacactgccgaagctggcaccatcatctgccccaaaaccttccaggggggccccgatggccacatctgtgagcttatcctgactgagatcccccatagccgccatggcaaagccaaagcgggcattggtgaacccggggtgcccactcagtatgcgtgccaaggagaaagaaccatcctgtaaagcaaacaaacagctcagccctcaagaaggggtgctaggtgcccactccattgccaccccgatgcacgctcactgggccggtgggtgcccactccattgccacccaggatgcacgctcgctgggccggtgggttcccactccattgccacccaggatgcacgctcactgggccggtgggtgcccactccgttgccacccaggatgcacgctcgctgggctggtgggtgcccactccgttgccacccaggatgcacgctcactggccagggaccttcccaaggccatacagtgagcaccaggggaaagctggggtcctcctacctggaagttcaggagtcagagcccgcccccctctagttccatgggcaggggtgcattgctgcaaatgggaggcctgggtttcactcgtggctctgccacacacatgccaggtacacttgagcaagtctcggcatcactgaggctcgccgagccccagcttcctcacccgtaagatgagagtggcagctacctcccatagttactatgagaaacaagtgagatcctggactaaacgggctttgccaaccatgcagctgtaagagatgttatcagctgggcgcggtgactcacgcccataatctcatcactttgggaggccaaggtaggtggatcacctgaggtcaggagttcgagaccagcctggttaacatggcggaaccccatctctactaaaattacaaaaattagccgggtgtagtggcacatgcctgtaatcccagctacttgggaggctgaggcaggagaatcaacccaggaggtagaggttgcagtaagttgagattgcaccattgcactccagcctggacaacagagtgagactcagtctcggaaaaaaaaaaaaaaatgctgggcgaggtggcttacgcctgtaatcccaacactttgggaggccgaggtgggtggatcacctgaggtcgggagttcaagaccagcctgaccaacatggagaaaccctgtctctaccaaaaatataaaattagccgggtgtgtggcccatgcctgtaatcccagctacttggtaggctgaggcaggagaattgcttgaaccccggaggcagaggttgcggtgagccaagatcctgccattgcattgcagcctgggcaacgagagcaaaactccatctcaaaaacaacaaccacaaaaaaagagatattagagatattatcatcaacgatcacccttgggtaagaaagtgggtgcggagagcgatgccgctgccccgcccagccgccatccagcctgagcacctccccatcactgcccactggtgccaggcagggccagggcactcccagcctccatcacctctgtgtcaggctgagtgccacagcctcagcaagctcatgaagatggagactctcccacctgctcgctgagacggtacacgtagactctgccttcttctccatgaacgtggtaaaatggagcagccaccagcaagaagtccgtgcttccatccatgtcaatgtccacagggcacagctcagagccaaaataggaccccatctacagcccgggaggaactcagctcaccaggagccccgctcctgcacccctcagcaaggctacacccctgcccgcgtgcttcctggaccacccaatttgggtcgttacatatcaatttgctcactgagagtaacagaagagtggaggagcagcccaggccccacagcggaggaaactgcctagcaatcagacatgcagagctgaagcagagccctcgagctccactcaggagcctgagtttcacccagcccgggccctggcccactgtgcaccgtgggacccactcctttcccttgggggcctccagattccccatcggtcataaggggtggaggctttccccagcaggtacctgctctccctccagcactggcaggaagctggcctctctgccctccttctggagctcaaacacggccccatgatgtttgtaccgtggagcccccgcgatgtaggagaggctgcaggtcttgtgcagcacggccacagcgtaacctggggcaagggtggtgtggctgtgaacacaccgtgtgctcccacctggcctctctcttggccccggcaccttcccagtcaggccttcaaagtggcctggggaggggggcaaaataggagagactgtctttctcactatgttaaaaatcggcatcagcgagcactctcactttgccagtcacacacatccccatcacacagatatgatgcacacgctgtctgtcacgtatgcagctttgctcgaaatactcgttcgcacacattcactacccacgctcccacacacaccctaggaggacggagaagaggggtgagaggacgcccaccactattattatttttatttatttatttatttatttttgagacagagtctcagtctgtcgcccacgctggagtgcagtggcacagtcttggctcattgcaacctccccctcccgggttcaagcgattcttgtgcctcagccttccgagtacgtgggactacaggcatccgccaccacgcctagctaatttttgtatttttagtagagacagggttttgccatgttggccgggctggtctccagacctcagatgatccgcccgcatcggcctcctgggattacaggcgtgagctactgcaccactattattaatggagaggccccgccctcccctgggtggctgctgtgcctggtgtgtacctgacaggccttgtacctacccaggaggctgtagtactcagcctcacggtccctaaccaggacccgcccctcggcccatgtgactgaccaggtcccgcccccatccggaaacctcaagtgcagcctaatgcgcagcctcggtgtccccatctcggccccgccctcgcccaggtggcctctaggccccgccctcacccaggtggtctccaggccccaccctcctcacgtaacttccaggccccgccctctcccaggtagcccccaggccccaccctcgcccacgtggcctccatgccccgccctcacccaggtagcccccaggccccaccctcgcccaggtagcctccaggccccgccctcacccaggtagcccccaggccccaccctcgcccaggtaggccccgccctcgcccacgtagccctcaggccccaccctcgcccagggagcctccaggccccgccctcatcaggtggccccgccctcatcaggtggccccgccctcacccaggtagctgtactgcgcagcctccgcgtctgccgccgccgccgctgtctggttcaggaagcggccccggcggctgcgtgtgtcgtagagcaacgcccctccggaccagtcaaaggccccgacggcgccgagcagcacctgccgctgaaggggacggggatggggcccagatgagtgggagggacccaaggccgggccacggtggccgcgggtctccgggccagcgcggctaacctggctgggagcaggggggcgttcggtggtctagtgcccgcctggccagagatgcaggcgggaaggtgagatggccaacactgggctcctgcctcgtgcccttgcactccctcctccgggagaagcaagcagcttggttgataagctgacccaggccgagtcctgttgcctggtctgtattcaggggaacaactggatgtttgagcacacagaaaaaagcgacctcctgtcatcaatatggccacccttttgttgcagtgagccgagactgcaccgctgcactccagactgggcgacagagcaagactccgtctcaaaataaataaataaattaattaattaaaataaaatcgctcttttacaggaatcaccacaggtagggcagagccctggatgggaggcaggagtccctgaatcctaggtgtcctgggcccctcaccaatgggcaagcctgcctggtgctgagtcagccacgtacctcatccaggatctgagcactgaagccaatctgtgccagctggtagtgaagggcgtctccaaccgtgcctgcaagccaagaagcccagtgagactgctgtgggccgaggtgaagggagaaactgagtcaggggacagtccagcttggcctcactcccagaaggaaccatgcttggtgtaacaggaagagaacccggctgagggtagagacccaggttctccttgagcaactactatctgggcagttcactctttctaggcctcagtttcctcgtctgtgagctcctgggagaagggactatgccccagccatccttgtttctccagcaccagctcagttcatcagagcttcatggagattctgggacgcaaggaggcctggggatattgttggcctttttttttttttttttttttttttttgagacagtgtctcactctgttgctcaggctggagtgccatggctcaatatcagctcactgcaacttgtgcctcccaaggtcaagtgacctggtgccttagcttcccaagtagctgggaatagaggtcatgcgccaccacgcctggctaatttttttttttttttttttgagatggagcctcgctctgtcacccatcctggagtgcagtggcgcgatcttggctcactgcaacctctgcctcctgggttcgagtgattcttctgtctcgggctcctgagtagctgggatcacaggcatgcaccaccacgcctggctacatttttttgtatttttagtagaaacaggatttcaccatgttggccaggctggtcttgaactccagacctcaggtgatccaccggccttggcctcccagagtgttgggattatgggcgtgagccaccacacctggccccagctactttttgttttagtagagatggggttttgccatgttgcccaggcgggtctcaaactcctggcctcaagcaatccacctgcctctgtctcccaaagtgttgggataacaggcatgagccaccacacccggccattgcctttttagacatggaagagctgaggttcagggagatgatgggagttgctcagagaaaccacatgaagatgggacagaggccgggctggagcataggctcgggcctcctgcggtggcctgggtcccggagccctcaccttccatgctgatgatgttgtaccgcagtttgctcagcagcccatccagcgccatgtagttggtcaccttgaaagcatgggtctcatccgggtctgaggcgatcaggttcagttccctcgcagtcctagcactcttaaattcttctcccacctgcacagacagcctgggtcagcgagtcagcgctgcgtggattccccaggcccagggagagagctgagcccctccatctggcctctggggccctccattacctgtctccttccttcctttctcctcctttccctgctccctgttctacccatactctgggcaaaattccagttttaccaaagtacacctgttctcctgaatacaccaagctcctcctcacctctgcacatgctgttccctctgcctgcagggcccctctctgcctcccctgtgccctaggccagctactcccatttgtctggcaggactcagcttggcaccgcggtcctccaggaaccctccttggtgtgtttcctgtggctctcccaccactatttggccagtaagctgtgaccaccatggggaaatgagccctctctgggatgacagagcatggagagaagaggagcatttgcaaatagaacagggtctggataagctgcttacagaaaagcccccatcgacaaccctggcttctccccaccccaggctgtgcaggttcaggaggtgtctcccggctcctggctcttaccccaatggcaaagcgctcaacaccctgcattttgggggagttgatgactgtcgtaaggttgagggggtcctcgaatatgccaccatcggtgagcaccaccatgaccttggatgcctttctcctggagccgtggcttgaggtgaagatgctgtctctaagcaggggagagtaaatgaagaagagagctttgccagaaggatgaccgagctccaggagagactttattctctgacctgtattagaattgggagggttcacaatcctcccgaaagacccagagaagggggtgatgcccccttaagtcacgcagcgaggctgggcagagggagggctgcaacacaggtgttcttgcttctcacctgctcccagcaggaaggtactgcctggcagtccattcctcttgtgtgcgtacaggaagactcatgatattaaaacgatagataatactcacatggcacttatcatgtgccaggcactgttgtaaacactgtatattttaagccatccaaccatcacaaaatctatcaggcaagtgctattatttttctttcttttttagagacggcgtctcactctgtcacccaggctggagtgcagtggtgtgatcatggctcactgcatccttgaacttctgggctcaagcaatcctcctgcctcagcttcctgagtagctggaactataggcacaagccactgctccaagctgtgagtactattattattctcattttatttatttatttttattattattattattgagatagatggagtctcgctctgtcacccaggctggagtgcaatagcacgatctcagctcactgcaacctctgcctcccgagttcaagcaattctccctgcctcagcctcccgagtagctgggattacaggcacctgccaccacacccagctaactttgtattttgagtagagacggggtttcaccatgttggccaggctggtcttgaactcctgacctcaggtgatccacctgtgttggcctcccaaagtgctgggattacaagcatgagctaccacgctcagcctatttttctcatttttaaagtgaggaaactgaagcacaggtcacaaggtccttcagtttgcccggggtcacacagatacaaaccagagctgaggccgggcgcggtggctcacgcctgtaatcccagcactttgggaggccgaggcgggcggatcacgaggtcaggagatcgagaccatcctggctaacatggtgaaaccccacctctattagaaatataaaaaattaactgggcgtggtggtggccgcctgtagtcccagctactcgggaggctgaggcaggagaatggtgtgaacctgggaggcggagcttgcagtgagctgagatcgtgccactgcactccagcctgggtgacagagcaagactccatctcaaaaaaaaaaacaaaaaaaaaaaaccagagctgagatttgaacccagccagcctgtccactgagcactctgctctcctgcatctcacaagaggaagtctttggaagactttttggaggacagccttgaggtgtcatccctcacgttctctctcggccagggaaaggctggagccctaattctcttctcctgcggttctggccagccacttcctccatgagtgatgccacagagactctgggcatggccagaataattcctgcagcccccacactcacaagacgtgttgcatggctgaggcagtcttggtgacactccccacttgagtgatgttctggactctggcgagggaggccatcacatcctggctgtcccgaaggtcaaactcagtctggatcactcctccatactgcaccaaggcaaagttgcactgcaggggatgggcaggagggcaggaggttggaagaattgccacctctgcccctgaaatgtctcccgctggaagcagcagaaaaatccactccttctaccttatccctgggcagaaagagatgctaaggcagagcaaaatctctaagcgagtaggggtggagaagggtgcgatagtaaaggcccccagtgaatcacagacttctccccagctccctgtgtagtgccctccatactgacgatgggattggtcatgtgactggctttggccaataagacatcagcaaatgtgatgtaattagagacttgaaaaatacttgcatgcattggatctggccctcttagaatgttgctgccacgaaaaagttgggctggcctgctaaagacacatggtccagacaagtaagtgaggtcatcttaggccatccagccccagtcaagcaaccagacgcctgcagctccagggtaactccaggcaagatggacagaagaatcatccagctgagcccagcccaagtatgtgacccatagaattgtgagcaaatgtggtgattgttgttctgaggtagggtgattctcagcaatagataagtgttaaccagctcttagggaagcccacctcaaaacacttttcatagaagttcctcatcatgttggagatgaagtctttggctctctgaaagtctgggggatcaatgcttcctgagccatccaggatgatggcaatctcggtgcctggccaagacaaacaggtcaggagtgggcatgggatgtgaggcagatgtaagggtagcatgtgtagggcatgcacccccactgcagccctgacaaccagctcagttcagggaagaagttggagaagctcccaagagggaagctttttttttttttttttttttttttttgagacagagcttcactctgttgcccaggctggagggcagtggtgggatctcagcttactgcagcctccgcctcccgggttcaagcaatcctcctgccttagcctcccaagtagctgggactataatgcacaccaccatgcctggctaatttttgaattttctagtagagttggggtttcaccatgttggccaggctggtcttgaactcctgacctcaagtgatccgcccacttcagcctcccaaaatgctgggattacaggcatgagccacctcacctggccccaagagagaagcttttgtctcccccttcaaaaagagagctagaacctggtcaggctttgtgtgctgtgtgagccattcccatcactaccactctctgagcctcagtttccccacttataagaaagagtgggtggagctggtacaggtcaggtctgtaaagtccagccactgctccccatctctcagactgaggcacccctcacccttggaggccaccagcctaggaattggctctgatagactcagagcaacccagatctgcctcttctcaccagcttcctcctcctcctcgtcttcctcctcctccttgtcttcctcctcctccttctccagagcccggcgctgcctggctgtgttcacatcgtcttctccaccgccttctttgttgctgtagcagtctccagtgtccacacgtgcatctggatccaggagattttctttaaaaacacacatggaagagctcagagtcagaaaggctccatcctcgcctgagcacgctcacacatggttctgccctgattcctttcacgtgatgcctcaaccctgccttgctccactgtgggcctgcgtcccactgcatctgccgtgagctggtgccttttcttggagaccaaggagatctctttagagctatccaaggccagtgaatgtccaatccttaccaaggtcgaagaagttggcctgagcctggggacggaggtcagggcccaggaggctacaggtgcctgtgagttctgagctgaggctgtgaggccgccggaccagcacttgaatgcatatctgtgggagggaagagagggtggggaaacaccaggtcacctcccgattcccgagccacagccacattctcacccccattccagaactcagtggctcaaccaggcagggggcacaggaagagctggcccacccctcaccgggtgtaggagtcagtgttggcatcaaggccgaggccgacacctgcaggagtgtgctgggtcacagggaatacctaggtcagccctggtatcagggtggtcagagctacagtcagccctggggttggcaccagggagacgctagactcagcctcgggaacagcatggcagtcagaactggtctcaacaccagggtcaaccacgagggctagcaccagcctccctaaggccctccctcctctcgctcctgcactcaccaaaacaccgtggtggctccggacaacggtcactccccggtgcctccccttggggatggggacatgctctgaaaaagttaagcccaggtgaggaggaggaggggactctgggaggcagagacccgaagccaaggtcagagggcacagagccaccttggtcaggcccccatgaggaactgttggccactcagagaagcctctagaaagctagagcgggggccttcaaggtcaggactggacacgttcagggccgagtgcccatccccggggctcatttgctgaccctttcaacacgtgcccattgacgtctgctctgtgcccagccttgtgagcgtggtgatgggcgtccagcaacagcggatgcctgctgcttttcctcagtgggtttggtcgggcaggtgggtggagaagcactgcctggtgggtatgtaagtgccaaggaatgtgcaagataccgtgggactggctgtgtggaccaaggaaccccccagcctcacagacccatcctggggaatcttactgcccccagcctcaggggcagaaatggtagctccttcctcgtcctccccactgtcagcctcaggatactgtcttatttttcagtcatggaatcactcagtcaaccctgctggactgagattgagtctgttcaactcagtgcctctcagacaaggattttttttttttttttttttttttttgagacagagtcttgctctgtcgcccaggctggagtgcagtggcgcaatctcggctcactgcaagctccgcctcccaggttcacgccattctcctgcctcagcctcctgagtagctgggactacgtgtgcccgtcaccacacctggctaatttctttttgtatttttagtagagacgggatttcaccgtgttagctaggatggtctcgatctcctgacccatgatcggcccacctcagcctcccaaagtgttgggattacaggcatgagccaccgtgcctggcaggattttttttttttaaacagtcttgctctgttgcccaggctggagtccagtggtgcaatgtcagctcactgtaacctccacctcctgggttcaagcgattcttctgcctcagcctcccaaatagctgggattgtaggcatgcaccaccacgcctggctgatttttgtatttttggtagagatggggtttcatcatattggccaggctggtctcgaactctggacctcaaatgatctacccgccttggcctcccagtgtgctaagattacaggcgtgagccacggcgcccagcctcagacaagacaaggattctatttatttatatatatatagccaagaggttgtcagtaaatctgtgacctgagtttgactgggtaggatggatagagtttaatgagtgaatcaggttcattcattcattcattcattcattcattcaaatggcatttattgagtacctaatatatgtcaggccccatgctagttactagggtggccacagttagactgaatatgtagggggtgaattgcactgaggtgtgatgacttgcatcaggaagggctagagtttcgaatcagccaccaacactaaaagtgtgaactttgtcatactggcaaccaaaagacctacattctctgaactgtagcttcctctcttataaatggcgcggttttgaggatgaaaacagaatgactcagaggactgccgggcacagggtgggcacgcaatacgctgtaggtatcatttctgttgctaggactgtgtcaggaaaggtggctggggattaggattgggttggggtgggactgggcattgggatggaatcttgctgtgggttatgctggagtctaggggtgaacgggctggatgaggcagggctggggttggaatggtttgagtttagatgagggggattttgctagaaagggggtcctggggagcattccctggagttggggctgacttacctacaggatggcaaaggatttcatcctggacaagggaacatcgatggaggggccctggtgtcctcttggttctggggctggtgaccaggagcctgagtgggaggggaggttgcaaagctgagctggctgatgttcctcgtcttctccctgcctgcccagcacccttcccattccagttgcctgcactcacaagctccctgtctggccggcagattcctagcccagactctggattatggggaagacatttgcccaacctctgcttctacacagcaccaggcaggaaatggttaaatgcaacccctctctgcctgctgcccaccctgacaaagaaggggtgatactgatggttaataaaaactctgctctcttatggggacagggatggggaggccagaaaaccaccagcgttggggttggttctgttgggggcagtgctggcttcctcgtgggccacccagggggcctgccctgcctggccttagttcctgagaagagtacgctggtgcccctatcctgtgggtcagtcagaactggaggtttggaggccgggcgcggcggctcacgcctgtaatcccagcactttgggaggctgaggcaggtggatcatctggggtcaggactttgagaccagcctgatcaatatggtgaaaccccgtgtctactaaaaatacaaaaattagccgggcatggtggcgtgtgcctgtagtcccagctactcaggaggctgaggcaggagaattgcttgaacctgggaggcagaggttgcagtgagcggagatcacgccactgcactccagcctgggggacagagtgtgacttcgtctcataaataaataaataaataaaagaactggaggtttgggggtggctgcctcagcctgattaaggcagcctcaagagctgcgcctcctgactgcaaacttcttgcccccacccaggcccagtccagggagacggcagattccagggacagcctcaacattctcaccatccacgttacccaggagaactgggctgtcctgagacagacagtgagctccgggggttgtcataggggatggtggggaggggacgaggggcttggtggttaacagtgaaccaagtccaaggtctttctgcagagggcagtagaagtcatggaggactttataaaggggaagcacatgattagctgtgctttcaaaagctcatgatgaggccgggcgcggtggctcacgcctgtaatcccagcactttgggaggccgaggcaggcagatcacgaggtcaggagatcgagaccatcctggctaacatggtgaaaccccgtctctactaaaaatacaaaaaattagccgggcgtggtggcgggtgcctgtagtcccagctactcgggagcctgaggcaggagaatggtgtgaacccaggaggcagaggttgcagtgagccgagatcacgccactgaactccagcctgggtgacagagcgagactctgtctcaaaaaaaaaaaaaaaaaaaaaaggtcatgatgtggctacagtgggttgggacagactaaagagcacaggaaggtggggcagaaatgagataccgtctccacttcctcaactcctatcactctacattttaatacattatgaaatatattcacgtatcggcatggcttacagaataataagaaagtctgcacctgtgcgtccatccgcccacccacaactgaacccaccccaagctgacttcccaccctctgagtcagttcctgtgaaggtcaccaggggcccccacaatgccacatccaacggaccgctctctgtcctcatcttcctcaacctctcagaagccccaaacatgagtaaccatctccttcgaacacttttttctagatttctgcctactctctcctcattcctcaaggcttcgctggtgccttcgcggtctgacctctatctgccaccaggatctgggggctgggtcactgtcttccttgccggcacactctccctagtgatcccttccaagcccatggcttcaatacacctataacggctgaaattcccacctctccatctgctatcgtaggcagaataatggccccccaaagaaggccacgtcctaatccccagaacctgtgaatatgttgccttttatggcaaaagggacttcgtagatgtgagttaataaattaaggatcatgagatgggggggttatcctggattatctaggtgggctcagtgaaatcacaagggtccttctatgagggaggccccgaaaacggtggcatgggcgagccgcagggactcagggggacgttgaggcaggcagaggggagaagtggcgagactgcagggaatgctgggagcctcccaaggaggcctctcccatcccagaagcccccagggctgtcctggctgggctgtaaagccccagtgtaatcacaaaagtccttctaggagggaggcaggagaatcagagtcggagaaagttgtgaagcttgctatgctgcaggcctaaggaggaggaggagcccgtcagccaaggaatgcaagcagcttctagaagcctaaaaaggcaagaaaacagattctcccccagagcttctagaagggacccagccctgctgatagcttttcagacttctgacctccaaaactacaagataataaacttgcagctgggctcagtgtctcacacctgtcatcccagcactttgggaggccgaggcaggcggatcacctgaggtcaagagttcaagaccagcctggccaacagggtgaaaccccgtctctactaaaaatacaaacattagctgggcatagtggtgaaagcctgtaatcccagctactcgggaggctgaggcaggagaatcacttgaacctgggaggtggaagttgcagtgagctgagatctcaccactgcactccagcctgggtgaaagagtgcaaaataataataataataataataataataataataataataataataataataataaacctgtgttgttgtaagccactacatttgtggtaacttgttacagcgtcgataggaaacaaacagaacctgtggtctttcctgtcaagcctgcttcttctcatcttccccgccacagcaaatggcaccagcaaccactaagttctcaaggcaaaacccaggaggcatcctcacttcgtcgtgttttcactcatgccctacatccaatccacctgccaaccctgttggttctctctccaaattcttttttttttttttctttttttgagatggagtttcactcttgtcgcccaggctggagtgcaatggcacgatctcggctcactgcaacctccacctcctgggttcaggcgattctcctgccttggcctcccaaagtgctgcgattacaggcgcccgccaccatgaccagctaattttcgtatttttagtacagatggggttttcaccatgttggccaggctggtcttgaactcctgacctcaggtgatccactcacttcggcctcccaaattgctgggattacaggtgtgagccaccacacccggccaatttttgtatttttagtagagacagggtttcaccatgttggccaggctggtcttgatatcctgacctcaggtgatccacccacctcagcctcccaaagtgctggaattacaagcatgagccaccgtgcctgactctccaaattatttctagaaagcaactcttctccagatgctccttccatcatcgtcctgccttgttgatggtaatagcctcctgttattttgtggggtttgtttgttttttaggtagtgtcttgctctgttgtccaggctggagtgcagtagtgtgatcacagctcactgcagccttgacctcccgggctcagcaatcctcctacctcagcctcacaagttgctgggcctacaggagcgagttaccttgcccagctaattttgttaatttgtctatagagatgaagtctcactgtgttgcccaagctgatcctgggctcaagcactcccaccttggtcttccaaagtgtcagagaaagatgcaaagcttactatgctgcaggcttgaggaggaggaggccgtgagccaaggaatgcaggcagcttctagaagccaaataaggcaagaaaacagattctcccccagagcttctagaagggacccagccctgctgacaccttttcagacttctggcctccaaaactacaagaaaacttctatattaatagaagtgagccactgtgcctggcccacttatttggtttttaatttactcatgtaattttttttttaagacagagtctccttctgtcacctaagttgaagtacagtggcatgatcacggttcactgcagccttgacctcccaggctcaagcgatcctcccacctcagtctcccaagtaactgggaccacagatgcgtgccatcacacctggcaaattttcttatgttttgtagagatggggttttgccatgttgcccaggctagtctcgaactcctgggctcaggtaatcttcctgccttggcctcccaaactgctgggagtgagcctagtgagttacagtgagtttcaggcatgagccacagcacctggcccactcatgtagtttacaccaatgtcccttctgtcagtggcagccccagttcctgggtgaccagcgccagcatttcctgcctcaggccctccacggcgctgttccctccacggcactgttccctccaccgcgctgtttcctattcccagagccctcaccttccactctccccaaggttggcttattctccttccccagcctcgcctgtcacctcctcataaatgctttctctacccagccgtgcctcacaacccagttactctgcttcacatcaccctgtttgatttccttctcagaacctgccatcatctgatagtgcctattatctgtctccccacgagacagtaggctcccgaaggatcttgtctatcttcttcactgtgttattcccagggtctggagcaatgcctggcacagaacaagggctcagtaagtgttgagtgactattgaacaacagcccaggcaacagctgagggggctcatctggggcagggctgaggggcggagggctgggtgcagcagagagctgctcctctgttccggctctgcagctgagcccccaaattaggttgcttccttagcaaccctgcctctctccccagccccgacctcagccctagacccagcatctccttccctgctcccccaggaagggtggggtcaaaactgggctccaccgcagaccccgttttggtggggtaggtgcaggcctggacccgcctccagtctctctcctcctcagtcctctgcccggactgtttcctctgcctgcgatccctcctgctgcagagcaatcatcccaaaccccagctcctcaggaagccttcccaaaggaagtgcagcctgatcccctccaggccctgcagcagccctgactatagcaccccacccccaccctttcttcccacctggactgcgcgttcccaggaggccatcatgaacagctgtgcagggtgcgcactgcagatcccaagactgccattcatgccgccatcatgcaatgacatggcctggggccctctgagctgcctctgcttcccacaccttttatcccccactgccgggagtttgcaggtttgttgaccacgtggctgacaaaccattgacccaccagctctgacagaggactggccatcagctcgcagccacaggggccctgttacaccctgagctgggtacagcccagcaacccttgtccatctcctgcctttatttattgctttagtatgtttttcgttgtttgtttgctttttgagatggagtctcactctgtctcccaggctggagtgcagtggcgtgatctcggctcactgcaacctccgcctccctggttcaagtgattctcctgccttagcctctgcctcctgagtagctgggattacaggcatgtgccaccaccacacccggttaatttttgtatttttattagagatggggtttcaccatgttggccaggctgctcttgaactcctgagctcaggtgatctgcctgccttggccttccaaagtgctgagactacaggcacgagccaccatgcctgaccttatttagtattttgtatttaaatgtttaacaatctttttaactggtcactgacttgaagctcacatcttgccttcacccagctctaacctgtcctgttctcagggtttatttctttctttcttttttttttttttcttttttttgagatggagtctcactctgtcgcccaggctggagtgcaatggcatgatcttggctcactgcaacctctgcctcctgggttcaagtgattctcctgcctcagcctcctgagtagctggaattacaggcacctgccaccatgcccagctaaatttttttttttttggtatctttagtagagatgggttttcaccatgttggccaggctggtctcgaactcctgacctcaagtgatctgccggcctcagcctcccaaagtgctgggattacgggtgtgagcccccatgcccagccctcagggtctatttccatgtctgctgtctgtcccacccataccttctgtggcaaccaaaacccatgatgctgccagccctggtctcttacattttaagagagacaatgtgagtgagaggcacacgtcattctcaagcaggagcacagcccctgcctttttctaggcccgagttggccagccagcgcacttcctgccccatgcagcaggcccgtggtctcaggccccactctctgcagcaggaacccagaagtgcctcccaccacatcctcctccccagcgtgttcaagcctgggagcccctctctgcttcagcaggtgttcagggagccccgctgggccctcccccagcccctggtggactcagagccctctgcgacacgggctccaaactctctcctgcaccctggcctttaggcttctgagagaggggctgtgaatgtcggtgggacctggagctgaggcgtggggtcgctgggtattggtgggagggaactaggcaggagacagttacagaaaacgctgactgaaacctgctcacaccctacaaacagtatggaaaactgaatgcagaaccaattgcataacttctgacccagcaatcccactcctgagcacatatgccctccccaaaaatgagtacattctttgggatcaactctgagggattaaaaaaaaaaaagaacattcatccatcaaaaggaggtgcacatcagtgctattcatcacagcccaagaaaacagcccaaatgccaatcatcagtactgtcgacacaatgtaaccctggcaaccagaagaagtaccgcctggggcaacacgatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctcttttttttttttttttttttggagagacagagtttcattcttgttgcccaggctggagtgcaatgctgcggtcttggctcactgtaacctccgcctcccgggttcaagcgattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcactgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgcaccgatgaaaccaggatccagaaaggactctctaatgatgtaggaaacgtcgagctctgtctcccctgcagctctcacaacacagaacagtccagtgaccccaggtgggtggggttttccctccacacggggcaagcagtccttcggcaaccagctccagctgaaggtcctcacgttcaactcaattccgacatgctccacctggaggtagcatcagccctcacaggtcgaggtctcagtcccacaagactgctcctaacttccgaggcccatcaccagccgccggttatttcacctgtgctttcgaccaaacaaccatatcagggtttctgggaccctttccttgggcttaatttgctagagtggctcagagaactcagagaagcacttaccgacatttactggtttattataaaggatattacaggccaggtgccttggctcacgcctgtaatcccagcactttgagaggccgaggcgggcggatcacgaggtcaggagttcgagaccagcctggccaacattggtgaaaccccgtctctactaaaaatacaaaactcagatgggcgtggtggcaggcgcctgtaatctcagctactagggaggctgaggcaggagaatcgcttgaacccagtggttgcagtgagccgagagcatgccaccacactccagcctgggtggcagagcaagactctgcctcaaaaagaaaaaaaaaagatattacaaaggatacagatgaggagatgcataaggcaaagtgggggtgaggggcaaagtgggggtgaggggcaaagcttccatgccctctcgggggccaccctccagaaacttccacatgttctgctacccagaagctccccaaaccctgtccttttgagttttatggaggcctcattacataggcatgactcattgaatcactggccgctggtgatcaactaaaccttcagcccttctctcccagaagaggggtgtggggctgaaagtcccaaccctctgatcgtgcctggttctctccagtgaccagcccccattttgaagctatctgggggctgccggtcccccgtcaactcattaacaaagaaaaagacatttattactttggagattccagagattttaggcatgtatgccagataatgggaccaaatgtttattttgagaccaaatatatttttatttgttatattgtaaaatatatattcagtcttggaatgtcaaatatacatttcacagtatcacaggatccaagtctgcctggctgtcagggtcaaggcccaagtcccagggcctatgaggctgcttcgggagccaccactgcccacccatcctattcaagcaaagctcccgccctgcccagccaggaaccctggctcctcacctggctctgccccagtgcctgtttgaaccctgggctcacttgctcctgtgtgctgggtgtgaaggaaacccttgaccactgaccaggagcaaagcaatctggtgggctggggtgggatgaggaggtaaccatcctaggctgggcccgctcagtgggagagtatgcacaagaaaagccctatgaccacccagaaaaaaatgggggagaaatcactgctttggattgaaatcaatgacagagacataacagcaatacgtaatacataaaccttgaccagatctggctttaaaacaacacagcactagaagtcattttggggccaggtgcggtggctcatgcctgtaatcccagcactttgggaggccgaagtgggcaggtcatttgaggtcaggagttcaagaccatcctggccaacgtggcgaaaccctgtttctactaaaaatacaaaaaattagctgggcgtggtggcgggcgcctgtaatcccagctactcaggaggctgaggcaggagaatcacttgaacccaggaggcggaggttgcagtgagctgagattacaccactgcactccagcctgggtgacagagcaagactctgtctccaataaataaataataggtaaagaaataaataaaagtcattttggtgacacatgggaaattcaaatgagcctcggatctcatgaccctttccaccagagcttctcctaactgcagacacactcctacatcagcacgcggccaccatcgccatctgagggaatgcatattttacttacttgcttcttttttttttgagacagggtctcgttctgtcacccaggctgaagtgcagtggcacaatcgcggctcactgcagcctcgactcacccgcccccgggctcaggcaggtctctcacttcagcctcccaatagctgggacggactacaggcttaaaccaccatatccggctgatttttttatattttttgtagacagggtctcactgtgttacccaggctggtctcgaactcctgggctcatgtgatccacccgccttgacctcccaaagtgctaggattacaggtgagccactgcacctgccaacctttgtatattaaattctacaacttgcctttttcaactcacggtatgtttccagatggatccaggtaaacaaccattgcactggcttcattcaggggatctgcttttagtattgcattgcatgagtcatatcagtatttttcccattttcctaagaggaatattgccagtctttcatgattccaaacaatgctaccacaaacattttttgcttgcttttctttttctgagacagagtctcgctccgtcacccaggctggagtgcaatggcacgatctcggctcactgcagcctccacctcctgggttcaagcaattctcctgcctcagcctcccaagaacctgggattacaggcgcccgccaccacacccagctaattttttttttttttgtatctttagtggagacggggtttcgccaggttggccagcctaggtctcgaattcctgacctcaggtgatccaccggcctcggcctcccaaagtgctgggattacaggtgtgagccactgcgcccggcacacaaacatttttatatgtgtctgagaatttctctagagctgggatcggggagtggaagtgtcagaggccacgtgcatcctcagctttaccagatacggcaaaattgctctccaaggtggtgatcgcaattcacactcccacacgtccctgtttcaccgcaaccttaccagcaatgttggcagattttacattttgcttatctaataggtgggtatagatgatatttaaaaaatgtaaagtaatgtttattgagcattaatgtggccagaaattgtgctaagccctttttttttttttttttttttgagacggagtcttgctctgtcgcccaggctgtagtgcaatggcacgatcttggctcactgcaacctccacctcccaggttcaagcaattctcctgcctcagcctcccgagtagctgggactacgcgcgtgtaccaccacgcccagataatttttgtatttttagtagagacggggtttcaccatgttggccaggctggtctccaactcctgacctcaaatgatccgcccgcctcggcctcccaaagtgctgggattacaggcgtgagccaccgcgcccggcagaacctgtgctaagccctttacatgcattatctcaaatagtctttgcgacaatcctgtgaagtaggtagttccccacgctgactgcagagaagggaaactgaagctcaggcccgagcaccttgctcaggctatgcggcaaatccacggtgaagctgccactgaaccctggctgccagagccacagcctgcctcttaccagtacacgcttgttcctcatagtttcagggtttttgttctggagacaggccggagtgcagtggtgcaatcacggctccctacagcctcggcctccgggcccaagtggtcctcctgcctcagcctcccaagtagctgagactacaggcaggcaccaccatgcccagacagtttttggttttttttgagttgggggggtctcactatgttgcccagggtggtcttgaactcctggcctcaagaaatcctccagcttcagcctccctaagtgttgagattacaggcgtgagccacggtgccaggcccagttttttctttgttattttttgtttccaaatgttctatattgaacatgtgttacttccataaggaacaaaagagccttaatatgctttattttaaaattgtcttttttttttttttttgagacggagtctcgctctgtcgcccaggctggagtgcagtggcgccatctcggttcactgcaagctccgcctcccgggttcacgccattctcctgcctcagcctcctgagtagctgggactacaggcgcccgcctcctcgcctggctaattttttctattttttagtagagacagggtttcaccgtgttagccaggatggtctcaatctcctgacctcgtgatccgcccgcctcggcctcccaaagtgctgggattacaggcgtgagccaccgtgcccggccactaaaattgtctttaagtccaccctccccctgggcaatggagcagggagaggcccagtgaggcgtgaggctggggttccgtggaccccacagaccagcccgatgcccacagcctctctcacaccttctctctttctcctgcatgcccttctgaaagagaaaggagttcctctcctgacggtggggtggggtgggctgccatggccgtctctggggcccatctcagattgcctggaagcccctcagtctgaaggcctcttgcccaccggccctactcaccaggtctggttggtgctggggtcttggtgcagaagggagctgagcacgaaaggggcacctcccttgggcgtgagccagggccgggccacatccacattgaaagcggccagcagggccaggcctgtagggaaaagaggagcgtttaatgaaagaggccttttactcccgttattccagcaaatcctgtggtgtcatgaaccccgttttacagctgagaaaagtgagactgcccagggatctttatgtgtgtgtgagagagaaagactagacgcaggtgtatctgacccagagcctctgatcctcctactaaaccaagctgtaccagtacccgagcccccctcctccaagaagccgcccctagctctccccaaagaagcacttcccacctcctcacgcctcttactgtcatttctgcacctgacacacagcgtgtactcacgtcactgcgtcttgtactgaagttacagtagactgtgagccccaggaagagggcctgtgtatgttctatgtacccccttcaagcgacccacgagaaaacgtatccccaaaactgcctgcacaagaatgttttataccagctttattcggaagagccccaaactgcaaacaacccaaatgtccatcaacaggagactggaaaagcccactgtggtatattcctacagtagaatcctactcaggagtaaagaggagtcaacaacagatacagcagcgtgatgaatcccaaaaatcattatgctggccgcgcgccagtggctcatgcctgtaatcccagcactttgggaggccgaggcggctggatcacttgaggtcaggagttcgagaccagcctggccaacatgatgaaaccctgtctctacgaaaaacgcaaaaattagctgggcgcggtggcacgttcctgtaatcccagctactcagaaggctgaggcaggagaattgcttaaacctgggaggcagaggttgcagtgagccgagattgcaccgctgcactccagcctgagcaacagagcaagactccgtctcaaaacaacaacaacaaatatcattatgctgagtgacagaagccttaggtcttccttctttcttctcatttatgtgtgattttttttatttacagcagaataggctcatgaattctattttattcaatggttataatctgttatcactatattggttctcaaagtgtcccttatttggcctttccatgaagaaatcattggtactggactaattctttcaccataaacaactagaatactggacaaaacctataaaatgttttcagacatttgacaatgggcagagcaggacagtgatctctagaaaacatggacaaataacacgagccctgtcgttaccctcagctttctttctggaggaattttatgaccctgatgtagggaaagggaattcaaacagagcacagcagatttgttaagctaaggcaataaaaatcatattgtataactccatttatatgaggttctagaaccagcaaaactaacctatagtaaaaaaaaaaaaatgcttgagaggatgggactaactgggaagggactagaaggaactttctggaatgatgaaaatattctatatcttgataggtgtttgaattaccaaggtgtgcatgtgtcagaacacacgcaatgaatggtccacttagaatttgtgcatgtcactgtatgtaaatattaccttaaagaagaagcacaaacacattttgttgatatgtatgctgaaatgtttagagttgaattatacttaagtcagcaatttatttttattaatttcttttttttttttgagatggggtcttgctctgtcgcccaggctggagtgcagtggtgcaatcttggctcactacaacttctgtgtcccgggttcaagcgattctcctgtctcagcctcccacatagctgggattacaggcgcctgccaccatgcccggctaattttttgtatttttagtagagacagggtttcacaatgttgaccgagctggtttcgaactcctgacctcaagtgatccacctgccttggcctcccaaagtgctgggattacaggtgtgagccaccacatccagcgtgcaatttactttaaaatgcatcaaaatataagatggcttgctggatgggtagatagatatacgtgataaaagaaacactcaaaagtgttgacaattgtcaaatttaagtgtagtgatgtggttgtccaccatataatttttcaacttttctatatatttgaaatttttcatttaaaattttttggggaaaaatagatatcgatagattacctcccaaagaggttttgccaattcatactccaacgacagcatgggagaaggtttatctcccccagtgttgcctggactgactgtgaagacattttcatccttgttttaagagtatatcatcatcttgttccaaaattattattatttttttaagatggagtttcgctcttgttgcccaggctggagtgcagtggcacgatctcggctcaccgcaacctctgcctcccaggttcaagcgattctcctgcctcagcctcccgagtagctgggattacaggcatgtgccaccatgcccggctaatttttggtttttttgtttgtttgtttatttgttttttttttttttttggaaatggagtcacactctgtcacccaggctggagcgcagaggcgagatctcagctcactgcaagctttgcctcccaggttcacaccattctcctgcctcagcctcctgagtagctgtgactacaggcgcctgcccggctaattttttgtatttttagtagagagggggtttcaccgtgttaagccaggttggtctcgatctcctgacctcgtgatccgcccacctcggcctcccaaagtgctgggattacaggcgtgagccaccgcgcctggcctaattttgtatttttagtagagatggggtttctccatgttggtcaggctagtttcgaactcctgacctcagctgatccgcccacctcggcctcccaaagtgctgggattacaggcgtgagccactgcacccggccaatttttgtattttcagtagagacggagtttctccattttggttaagctggtctcgaactcccgacttcagatgatccgcccgcctcagcctcccaaatattttttactttttattttattgagacaagatctcactctgttgccctggctggagtgcagtggcatgatcatggttccctacagtctttacctccagggctcaatccatcctcccgcctcagcctctcaagtagctgggaccacagatgcgcaccagcaggcctggctaatttttaaaaaattttttgtagagatggtgtctcactatgttgcccaggctggtctccaactcctgggctcaagtaatcctgccatctcagcctccccaagtgctgggattataggcgtcagccaacaagctcagccccaaaactatttttaaattatgagtgaggtcaagtctctttttgtaagtttgtttactgcctactcatgtacattattcattttcatgaaacgatattactttcttatttatttgtaagagcttttctctatccaagagaaacaggcaatgtgttatagatgccgcttctcacgcagctgtttgtcttgcatatgctgttttcccccacaactacgttttttgatgttgtcatattgtttttcctttatgacttcagcttcgggtcatgctcctccactcaggctatttcttttcatccactcatgtttccttctatattttttttcttctttcatttcttttttctttctttcttttttttttgagataaagtctcgctgagccgcccaggctggagtgcagtggcgctatctcggctcactgcaaccaccatctcccgggttcaagggattctcccatctgagcctcttaagcctcccaaatagctgggattacaggcacccgccatcatgcccggctaatattgtattttagtagagacggggtttcaccacgttggccaggatggtcttgaactcctgacctcaggtgatccgcccgcctcagcctcccaaagtgctgggattacaggcgtgagccaaggcccggtctcttctttaatttcttatgttcgaaccttttgtccatctggattttatttttacatttggagtgaaatagggatacaactttacttttttcccacagttgaaatgtctcatcattatttgttgagtagctcctcttaacccatagtttggaaatgctacctttatcatcctcagaattcacatgcacatttgggcctctgtcaggactcagctctgccccactgacctcatcgtcttttgcttggacacgttagtctcctggcctctttcaagacttgtacttctggatacatcctctccacatcagatgctagaaagattttttaaaagcatggtctgggccgggtgcggtggctcatgcctataatcccaacattttgggaggctgaggcggtggatcacctgaggtcaggagtttgagaccagcctgaccaatgtggtgaaacactgtctctactaaaaatacaaaaattagccgggcatggtggcgggtgcctataatcccagctactcgggaggctgacaagggagaatcgcttgaacctgggaggcacaggttgcggtgaactgacatcgcgccattgcactccagcccgggtgagagagtgagactcggcctcaaaaaaaaaaaaaaaaaaaaaaaaaaagcatggtctgaccatgccactccattgcttaaatctctagtgtgtgtgtgtgtgtgtgtgtgtgtgtgtacttttttttttttgagatggagtttcgctcttgtcgcccgagctagagtacaatggtgcaatctcagctcactgacaccttcgcctcccaggatcaagcgattctcctgcctcagcctcccaagtagccgggattacaggtacacaccaccacccccagctaatttttgtatttttagtagagataggttttcaccgtgttggccaggctggtctcgaactcctgacctcaggtgattcagccgttcaacgtgctgggattacaggtgtgagccactgctcccatctctaatctacatttacatgggaaaaaagcaaggtgaagtccagtttacagacttacctgttcaattactgttcaattaacgacttttgccataaacactcttgaaaagctatacaacttcttggcaacactcctttttttggtttagtgactttttcgtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaatcccatatgcctgcttttgctgatgtatgtcgattgagatggctgaagattctatgattctgaagtcgatgagcgcacagcctatttccatgtgtttggaagtgcttttgggttcagtatttattttgccctcaaggtgtttctctgtaacttttgctatgactttattttttatttttatttttttgagatggagtctcactctgtcgcccaagctggagtgcggtggcgcgatcttggctcaccgcaacctctggctcttgggttcaagcaattctcctgcctcagtctccggagtagctgggattacaggcgcccgccaccatgcccagctaagttttgtattattagtagagacgaggtttcaccatgttggccaggctggtctcatactcgtcctgacctcaagagatccgcccgcctcagcctcccaaagtgctgggattacaggcgtgagccaccgcgcctagcccccactgtcaaatcttgtcttctccttttaatgaggccaataaaccttcatgacaatacattttatacggaaactgtatttttatattcaaagtattgtttttatttatctaaacttgttttattggtcaattaatacattttcctaacagtaaaagtcatttgagtatctttggttggctggaatgcatcacaatttttttaatgaaattgatgcaaatattttttccaattaatggctgtttactcagcagtagatttcaggaagaaattaaaatcactacatgaaggacaagtgtataaacgacactagcttctgtataaggaagggaaggagatatatgcacacaaatatgttgtttttgattcactaggaagatgtgacaattttaaatctgtatttatccaataacatcatttcaaaatataaaagcaaaaattgactgaattaaaaggaaaaatacaaaacactacaatgaaagtgggagactttaacactttaattaagccttttacgtcaactataaaagcagaccagcggggcgcggcggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggttgaggcaggagaatggcgtgaacccgggaggcggagcttgcagtgagccgagattgcgccactgcactcccgcctgggcaacagagcaagactccatctcaaaaaaataaaataaaataaaaaaataaaaataaaagcagaccaaaaattgagcaaggatatagaagatatgaacaacataattagcaaagttgacctgacagacaaaactctgtacccaacaatggaaaaagaaacatttttcttttttttttgagacggagtctggctctgtcaccaggctggagtgcagtggtgcaatcttggctgactgcaacctccgcttcccaggttcaagcgattcttctgcctcagcctcccgagtagctggaactacaggcacgcgccaccatgcccgcctaatttttgtatttttagtagagacggggtttcaccatgttggccaggatggtctcaatctcttgacctcgtgatccacccacctcagcctcctaaagtgctgggattacaggcgtgagccaccgcaccctcagaaacattattttcaagtacacgtgaaacatttaccaaaattgaccatatgctagatcacaaagctaaagcctcaataaatatcaatgaattgaaataactcagaatatgttctctgactatactagaatctaaaccaataacaaaaagaaaactagaggtccagcacagtggctcgtgcctgtcatcctagccctgtggaagactgaggcaggcagattgcttaagctcaggagttcaagaccagcctgggcaacatggctggtatctaacaaaaataccaaactccatctctaccaaaaatacaaaaaattagccaggaatggtggcatgcacctatggtcccagctactcaggaggctgaggtgggaggactgcttgagcccaggaggtggaggttgcagtgagccaagattgtatcactgcactccagcctgggtgacagaacaagaccccatgtaaaaaaaagaaaaaagaaagaaagggaagaaaagatggccggacatggtggctcatgcctgcaaccccagcactttgggaggccgaggcaggcggatcacttgaggtcaggagttcaaaaccaccctggccaacatggtgaagccccatctctactaaaaacacaaaaatcaggcaggcatgctgacagccacctgtaatcccaaccacttgggaggctgagacaggagaatcacttgaaccagggaggtggaggttgcagtgagccgagatcgtgccattgcactccagcctaggcacagagtgagacttgggaaagaagaaagaaaggaaggaaggaaggaaggaggaaggaaggaaggaaggaaggaaggaaggaaggaaggaaggaaggaaggaaggaaggaaaactagaaaaatctgaacctcgtgaaaattaagcaatgcatttctaaataacccagggtgaaagataaaattacagtggaatagcaaatcagacctaaaggaagtacgggaaggaataaagatatgaacacgtatcaatgaaacagcaaaccaacttacagtagagaaaactaatgatgctgaagttttttttaaagatttttaaaatgataaatcactagcaatactgaacaagaaaaaaaaaagagaacacacaaattaccaacatgaataaaaaatagaaaggggggacatcataatagatcctaagacatttaaaaaatagaggggccaggcgaggtggctgactcctgtaatcccagaactttgggaggccgaggcgggcggatcacgaggccaggagatcgagaccgtcctggctaacacggtgaaaccccgtctctactgaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggtgacagagagagactccatctcaaaaaaaaaaaaaaaaaaaagtaagaggatgttatatccaaccttatgccagtaaacttgacaatctgggtgaaatgaacaaattccttgaaatagaaatgcaccaaaactaacaaaaaaagaaatgtatcacctgagtaagatattttactcatgactaaaaatcttagggagatctctacgcccagatagcttcactgacgaatttttccaaacatttaaagagaaataatgccaagtttatataaactgttttagagaatagaaaatgagaaaacatttttcagtcattttatgaagccagtataacattgatattaaaatccagcaagcacaataaatgaaaggaaaattgaaacaaccgtctctctcgaacataaatacaaaaatgctgcacaaaattccagtaaatcaaatccagggaattataaaaagcataatacggccgggtgcagtggctcatgcctgtaatcccagcactttgggaggccaaggccagcggatcacgaggtcaagagattgagactatcctggccaacatggtgaaactccatctctactaaaaatgcaaaaattagctgggcgtggtggcgcacacctgtagtcccagctactcgggaggctgaggcaggaggatcacttgaacccgggaggcggaggttgcagtcagccaagattgcgccactgcactccagcctggtgacagagcgagactccatctcaaaaaaaaaaaaaaaaaaaaagcatgatacatcaaaacaagcagagttcatttcggaaatggaagagtggtttgacatttaaaataatcagtttactccttacaacaggaaataaaggattaaaaatcatatgattatgatagatgcagaaaatggcatctgataaaatccaagactaatttctgataaaaagtcctagcaaaccaggaatcagagggaatttttttttccttttttttttgagatggagtctcactctgtcgcccaggctggagtgcagtggtgtgatctcggctcactacaacctccgcctccctggttcaagcgattctcctgcctcagcctcccaagtagctgggattacaggcatgtgccaccacacccgcctaagttttgtatttttattagagacagggtttccccatgttggccaggctggtcttgaactcctgacctcaggtgatccgcccacctcagcctcccaaagtgctgggattacaggcatgagccaccatgcccggctgtgaatttctttaatctgatgaagaattaaagcggtggggtctagctatgttgcccaggctgatttcatacaccggccttaagcaatcctcccgccctggcataccaaagccctgggtttccaggtgtgagccactgtgtctggcctgctatgagtgtcttgcagacgtcttcatgaccatatgaacacattcctgttgggcatatgtctaaccgtggaacttctggatcctgttaagcatatgttcagctttagtggatactgacaaatggttttctctttttttttttttttgagagggagttttgctccgtcgcccaggctggagtgccatggcacaatctcagctcactgcaatctccacctctcgagttcaagtgattctcctgcctcagcctcctgagtacctggaattacagatgcccgccaccacgcccgggtaatttttgtatttttagtagagatgggcttttcgccatgttggccaggctgctctcgaactcctgacctcaggtgatccacccgtcttggcctcccaaagtgctgggattacaggtgtgagccaccacacctggttttaatttgcctttctctgacgtctgaagtctccttacaagattcctgactattttgataatctcttttgtgaaatgtcctttttctgtttgtggacatgcctttttcttattgatttgtagaaattctttacatattctgaagttaatcttttatcaatttgtgttgcaattattttcttattctgtggtttgccttttcactcacttacttttttttttttttgataaacagatgttcttaagtttaatgaagttcaaaaaaaatttttttagcccccaaggttgtacacagtatgttttctttcttttttgctttttgagactggctgtcactcttttgcccagcctggagtgcagtggtgtgatcacagttcactgcagcctcaacttcctgggctcaagtggttttcctgcctcagcctttcgagtagctgggactataggcctgtgccaccagacctgactaatttttttttttttttttttttttggtagaggcgaggtttcactgtgttgttcaagctggtcttgaactcctaggttcaggtgatcctcccaccttgggctcccaaagtgctgagattacaggtgtgagccactgtgcccagcctgttctgtttcttgatacgggtgtgacttaatatgaacatttactgatctaaatttgtccatttttctgtatgttgtacttttaaaaagtctacattaaaaataataattattaaaataattatttaaaaataataattattaaaataattatttaaaaataataattattaaaataattatttaaaaataataattattaaaataattatttaaaaataataattattaaaataattatttaaaaataataattataattaaaatattttttagaataagaattacaagtatgtgaaacacactgaatatataaaactttcataagttcatgatatttacaagagagagaaaaataaaaacaaaagaaatcaaggtgactcacgcctgtaatcccagcactttgggaggctgaggtgggaggatcacttacactcgggagctcaagaccaacctgggcaatacagtgagactccgtttctacaaaaaaattaaaaaattagctgcacacagtggagcctgcctgtggtcctagctacttgggaggctgaggtgggagaatcacttgagcccaggaagttgaggctgcagtgagccttgatcacaccacagcactccagcctgagtgacaaagcaagactgtctccaaaaaaaagaaacgaaaaagaaaatttgctaccaatggaagtaaaaagggcaccatctctttactctgaaaactgactgttaggaaaagtattaagcatttttcttgcctttcctacatgaagtgcatttcagggccatcaaatcatcctggttaatgagaaaaagtacttcttgtcttttaagttttccttccttccttccttcctcccccctccctccctccctcccttccctctctctctttccttctttttttttgttttttgttttttgagatggagtctcgctctgtcacccaggctggagtgcagtggtgcaatctcggctcactgcaacctctgcctcccaggttcaagcgattctcctgcctcaacctcccctgtagctgggattgcaggcatgtgccaccacacccagatcaattttgtattttttgtagagatggagtttcactctgttggccaggctggtcttgaactcctgatctcaagtaatctgcccccacttggcctctcaaatgctgggatttcaggcgtgagccacctcacccagccttaaatttatttttcatttgttcatctggcccttataaaaatggcatgaaaaacgtcttttttatggataaattattactaataaatgtaggaagaataatagaaccaaactattttgtgagccctaatgaaatacaataattaattcaggccaggatcatcaacaggtaaagcttctaaatgagagtctgatagactaactttacaattaggctgacaccacctgagcccactagtcaatcttagcatccctaggagtgggcctctcaggcatgtccttcttggtgtgacactctaggaaggatctaagggcccaagactacatttccaacaagattctaagggacacccacactgcaggtcttcagaccacattctgagtaccaaggctttaaaacacttcagcaaagaaaagaaaaagaagggccaggcacagtggctcaggcctgtaatcccagcattttgggaggccgacatgggtggatcacctgaggtcaggagttcaagaccagcccagccaacacagtgaaaccctatctctactaaaaatacaaaaattagctgggcgtagtggcgcatgcctgtagtcctagctgcttgggaggctgaggcaggagactcgcttgaacctgggaggcggaggttgcagtgagccgagatcgcaccactgcactccagcctggtgatagagcaagactccgtctcaaacaaacacacacacacacacacacaaaagaaaaagaggtgaaataactgcaggaagtggggcaaaatcctcacaactgcttagagtgtgctcgccacagaactgaaacctgacgttaaacttccagttttcaggcagtttggggaataaaaagacaaatcacaccaagaggaagcaaacacacaaatcctgaacatagatattctgcaacacacgtgaccaaactctgccataaatcaaaggcatgaaagcagaaaatggggatgggggtgcactccagacggagagccacagcaaccgcatgtcatgtgcggaccttgtttggatcttgctttgaacaaaccaactgttaaaaagacatttggaggccgggcatggtggctcacgcctgtaatcccagcactttgggaggccaaggcaggcagatcacgaggtcaggagatcgagaccgtcctggctaacacggtgaaaccccttctctactaaaactacaaaaaaattagccaggcgtggtggtgggcgcctctagtcccagctacttgggaggctgaggcaggagaatggcgtgaacccaggaggcagagcttgcagtgagcagagatcgcgccactgcactccagcctgggcgacagagcgagactctgtctcaaaaaaaaaaaaaaaaaagacattttgagacagagagatttgtatatggactaagtatttggtattagatgataccaaagaattaatttagttaggtggtaagaacattgtggctatttaagaaaatgtccacgttctttattattgagactgagtcgtactctgttgcccaggctggagtgcagtggtgcgatctcagctcactacaacctctgtctcccggattcaagtgattctcctgcctcagcctcctgagtagctgggattacaggggtgtgccaacatgcctggctaatttttgtacttttagtagagatggggtttcgccatgttggccaggctgatttcaaactcctgacctcaggtgatccaccagcctcagcctcccaaagtgctgggattacaggtgtgagccaccacgcccggcccttcatgttctttagaaatgaaaatgtccatgttttttgggagtgaaatgacacgatgtttggggtttaaaatactgtttctgaaacattagcgtgcaaatgagtcatcggagatcttgttaaaatgcagattctgactcagcagataatgaatcagaatggggctgggagtctgttccaacaagctcccagacgatgctctcactgctggtcctcaggtcacattttgagcagccaggctttaaataccttgacaacaaaaatgaaaaggggaacacaaaatacattcagcttgtgtggcaggatcttgatcattgtgtcatccgcttgatggacatattggctttgttatagttatctcgtttacctgtgtacatgcttaaaattttattatccaaaaatcaaccttccagacttgaggaggaggaggaacctggggagatggctctgaggccaggctctggatctctcatccctgcatttaaggccatttccctgagtctggcacaaagtagatatctatatttaattttattttatttatgtatttattttttgagatggagtctggccctgttgcccaggctggagggcagtggcgcgatctcggctcactgcagcctctgcctcccgggttcaagcgattctcctgcctcggcctcctgagtagctgggattataggcacgcaccaccacacctggataatttttgtatttttagtagaggtggggtttcaccatattgcccaggctggtattgaactcctcaggtgatccgcccgccttggcctcccaaagtgctgggattacacgcgtgagccaccgcgcccggcctgatatctatattttattcctttttcttcacatctctgcctcgcctggaatgatttgtggtgattcataaaaatacataatacaggtaagataaaactcgcttaaaataatggggcaggcaaaaaagaacagaaggaaaatgatggtttaaaaaaagagggggatacaacaagccaggaaggaggccaacagctaacatgtagatcacgcagtgccagcactttctatcacgtgccccactgttggctctgaacacagcgctggctcacagaagtgttcctaaaatcctttggcttaataaaatcatttgttgattcaacgcatacatgaatgaatgaagctttcttgaaggtgatatcaacatgaaaaagatcagttaatgccatgcggtgtccacaaaattcaaaaaacaaaacacttccaggcaaagcacaaccagtctggttattcaaatcagagaaaaaactgtccctaagggtcctttgtgagaacacaatgaagaaaccctgcaccccagcttttgcagacctgtgatttgtgtcctccctgccaatgccccaaagtagaaaacacaggaaacataaccagaccagacgttcttgtttgggggtaatggatccctttgagaatctttttcttttttcttttttttttagacagagtctcactctgtcgcccaggctggaatgcagtggcacaactttcgtctcactgcaacctccgcctcccgggttcaagcgattctcctgcctcagcctcctgagtagctgggaaaacaggtgcccatcaccatgcccagctaattttttgtatttttagtagagatggggtttcgccatattggccaggctggtctccatctcctgacgtcctgatccacctgcctcagcctccaaagtgctgggattacaggtgtgagccatcatgcccggcctttttttcttcattttgagttggagtctcactctgtcacccaggctggactgcaatggtgtgatcttggctcaccgcaacccccacctcctcagttcaagtgattctcctgtctcacgtgggccctggggccggagcccagactccctactgggcatcccttatctcagctctggattcgtgggggagcagcaggaacagtacagccttcttccctgcctaggggtcttgatctggaacctttgagagtctatgtaggctgtaagtggccactctcccagcacctaccgagtgtaggccaggactcaaaatactgggtctctggagtagctgggactacaggcacatgccagcactcctggctaatttttgtatttttagtagagatgtggtttcaccgtgttagccgggatggtctcgaactcctggcctcgtgatccaccaccttggcctcccaaagtgctgggattacaggtgtgagccactgcacctggccccctttgagaatctgatggaagcattggagcccttcctgatcccctgagtgcacatgtgtacaaaatcctccccttgcctgattgaagtgctctgtcctcagcctgtctcctggcttcctcttcatccttttttttttttttttttttttgagatggagtcttgctattgtcgcccaggctggagtgcaatggcacgatctcggctcattgcaacctccgcctcctgggttcaagcgattctcctgcctaagcctcccaagtagctgggattacaggcacctgccaccacaccggactaatttttgtatttttagtagagacggggttttgccatgttggtcaggctggtcttgaactcctgaccttgtgatccgcccgcctcggcctcctaaagtgctggaattacaggcgtgagccaccgtgcctggcctctaatttttttttaaattttttgtagagatgggggtcttgctatgttgtccaggctggactcaaattcctgggctcaagtgatcctccagtcttggcctccctaagtgctgggattacaggagtgagccactgtgcttggccttccttgtttccctattgccagtgactgccccctgccaccagtgagtccaagggggcacacactgcatctgcctcgatcgccacattatctcagggcctggcatggtggcccaccctcggtaggtgctgggagagtggccacttacagcctacatagactctcaaaggttccagatcaagacccctaggcagggaagaaggccgtactgttcccgctgctcccccacgaatccagaactgagataaaggacgcccagtagggagtctgggctccggccccggggcccacgtcacgttgagccctgtgcctcctggtcagtcactctggggaaaaaacaggacgtcagcaaactgcctagaggagaattaaaaagtgcgagctgccaacatgttacgaggggtgggtggggggccttcttccccccgtttcactgtcggtataactgaaaaggcacgagtggaggccgcagagcaaagtccagtctcctctcctgggcgtccgtggcacccccccgctctgcccggcgcaccctctgcacactcctgcctccaggcctcgacacagcggctccctccacccagcaggcctgctcagcactctccacctctgtctgcaaagcccgtcttttgtggccctgctcagccagccaggagccaggagccaatccagactcagtcagagtaactcccgggtccctgagccccctcagcaccctgtggtctgtctggctctgaccaaaccctgagccccctcagcatcctgtggtctgtctggctgtgaccaaattctgtctggatcagggtgatctgtgattcagtttgtctgccctgaactgtgatgtgatctgagtcacacacaacacccccagccacagagcccagctcagcgcagggccaggcccacccaaaaaaggtgctctaaaaaggtcagagtgggccagatattccctttcctcacgccaccccacccctgtgttcactttgttcaacagagatcttgttcaactgagggttccgctcccccagagcacctgttgccttccaggcaccacgctaggtgctgaggctcagagaggggtgtggtttgtgcatggcccgtcggaagattgaatatttgtgtctggggctcagattctgtgtttatgcccgatttcaaagcctttagtaatagctggaggcaccgaggggttggtaaacagagagaggccagggtcacaaatggcctcaagaagctgggcactgctcctgccgtgcggcggctcactgagctggagcagggctctgcttacagggctggtaactaggtcagcaagagcctgccgcagaggcacggtggcatgagactgtgtacgtgcgtgtgtgcatgtgtgtgcatccgtgtgtgcttgtgtgcatccgtgtgcatccctgtgtgtgcatgtgtgcatctgtgtgtgtgcatccatgtgcatccgtgtgcgtgtgcatccgtgtgtgtgcatctgtgtatgcgcatccgtgtgtgtgcatccgtgtgtgtgcatccgtgtgtgcatccctgtgtgtgcgtgtgtgcatccgtgtgtgcatctgtgtgtgcatccgtgtgtgcatccatgtgcgcgtgtgtgcgtgtgcatccgtgtgtgcatctgtgtgtgtgcatccgtgtttgtgcatccctgtgtatgcatccgtgtgtgtgcatccctgtgtgcatccctgtgtgtgcatccatgtgtgtgcatccgtgtgtgtgtgtgtgtgcatccgtgtgtgtgtgtgtgtgtgtgtggtggggtagttcgctgtatttgctgggctttccctgagagccagctggtgcccaggtctgccaggcctggctcagcttgtttcctcagactggactcgccccaggcccaacagtttgcctttgagctgcgcctccatcaggaaaccacctcctgttgcatttcccaccaggactcagaaaacagcattgtcttggtagatggtcttgagttcaaatcctcactgccttggagtcactgaaggaccctgggcttggcacctcgcttccgtctcccctctgggacatggggctgtgcagatcaaatggggcgatacgcggccccaggtctgacgcaggaggctcagcacgtggaggctgaggttggagagagttataaccacaggcgagggctggccctccctcccaatcccccctcccgtgttgtctgacttacagacatagctacaccagtgtctgtcaccacactacccacaggaccacctctctgagctgtccccagccacggaggcctgctgagtcagaccgagatccccctccatcctgtcagccaccactgtctcccctcaaccctctgtctcccccagcacaccgggcaatttcaactcacattctcacagtacaataagtaccacgattcccaatttaggaaaccgaggcccatggggcatgatttgcccacactgataccaggagctgaagaagtggggctagatgcaggggtcccgacaccccgcccagaacacccagcggggcctcgtgggaggactgtgcctcagagccatctgcagccagccgcagtccccccacctcgatcttctacacggagcctcatcaactccaccccaaacctcacagtcagctgagcccatctctctccctcacccttcatctccctaataacaagaaaggccaacaggccttgagcactactgtgtgctggaaactaaatatatatatatatatattttttttttttttttttttttttttgagacggagtctcgctctgtcgcccaggctggagtgcagtggcgcaatctcggctcactgcaagctccgcctcccgggttcacgccattctcctgcctcagcctcccgagtagctgggactacaggcacccgccaccatgcccagctaattttttgtgtttttagtagagacggagtttcactgtgttagccaggatggtctcgatctcctgacctcatgatctgcccaccttggcctcctaaagtgctgggattacaggcttgagccactgcgcctggccttttttttttttttgagacggtgtctctctctgtcttccaggctggagtgcagtggtgtgatctcagctcactgcaacctctgcctcctgggttcaagcaattctcctgcctcagcctcccaagtagctggaattacaggtgcgcaccaccatgcctggctcatttttgtatttttagtagagacggggtttcaccgtgttggccaggatggtcttgaactcctgatcacaagtgctctgcccgccttggcctcccatagtgctgggatttcaggcgtgagccaccgtgcctggccaggaaactaaacgtttctcatgagtgtgtcctcctccccacgtctgccttccgcaacagccgcagatggggccaaggcagcagcctcctcacgggcctctctgcctcccctctcccccagattccaactaacacacaacatacaattctgtcgccatcctggtcaagaccttctgtggctccccactgccctcagcaggaactccaagctcccccaggccggcactcaggtccccacgttcctcaccacctccaccgtgggcctctcgggactggatgcccgcattcctccacttataccacacctgccacacgaatgcaggcctcccagagaagggcagggatgtggggctcccacacggcccacactcccccagccagctctcccccacacactgcattccgggggcatttcacctttgcttgggctgcccctctgcctggagtgccccttccctacccccgtgctgtgacaccctgccggggccggggaggctactgtgtgcacaacctgccttctcttcacacaggggctgggataggggtggcctcgcctctgcccgcacctccagggcccagcatgtcccgatttggggcggggctggaagggaaagcaacaccagaggagacaatctcctgctcccactcacacttcgcctccatcttcctacaaaccagactcttcacaccccagggcttggtccctcctatcccccctgcacagaaggcccctctgctcacccccagcctgtacttgccaaggacctccccgtccttcagagcccacctcagatgctacagtctcccactccccaaggactgaggttttctatcacgcacaggcccggggtgatgccccggcacagcccctggcctcagcccgagtgcgtgccaccagcagagcgggccctggacttctggttccttcttcttcacccctgtaaggtgttgtaggctgacaggacaggcttcttcacgcaagggtggaaactcaacctctgagacccaggatggagaagtgagttgatgtgactgcagaatgagtcaggggtgaagactgacttggggacagcaggccacagggtaagagggcatgatggggctggtggtcagggtgtggacagttccagggtttcagtgtctgtctgcacccaatgcttctaaaatctcccttagacaactgctattattccgtctgctgccacaaataagaagtaggcatcaccagagtggctggcctggagagagtggaaggtcagggccaggccaggccagtcctggattctctccagcctaaggaggcccaacccggcacagggtacagggtgctgggcctggagccacagtctgagggagttcttcctcccagcatctcctggacattttctttctcagactctcctcagcccccaagactcaacgccacctcacctcctccaggaaactctcctggactggcccatcctagtctcaggacctcacagcatggagcagaactgcagcagcctcgtttccgccacccacaccggagctgcgggggccctgctctggtccccttcccgtggctgagctgagctgtgggctaagtggtctcatggcaagtctgctccatcatcgctctctgctgcccatcagcttgggaagggcctaggcctcaaaagaggtttgatcgatgccacctgctggaaaaggcactgaggtgatgggtggtggtctcagaggctaaaggagacagatgagccacaggagtattctggagctgggaggcaggacagaggcctgggcttgagcctcgtgtctattatcagttgcttgcaagcctgggtagtcactgcccgctctgtgccccagtcacctcctctgtactgggagagggtagacaagagtctagtctaagcatctgctccagatattcttggtaatgggagatcaaagccacaagccataaaaagagtgagactctctccacaccccacatgtaactaaaaacagagaagtctaaattgtaaaataaaaggaagttcaacaaactgttgacctttccatggtgactattctgatgtttttgaaatataaaatattaggccgggcaaggtggctcatgcctgtagtcccaacactttgggaggccgaggcaggtcgatcacctgagggcaggagaccagcctgaccaatatggtgagaccctgtctctactaaaaatacaaaaattagccaggcgtggtggcaggcgcctgtaatcccagctactcgggaggctgaggcaggagaactgcttgaacctgggaggcagaagttatggtgagccaagatccagcctgggctccagcctgggcagcagagcaagactctgtctcaaaaaataaaataaaataaaatgaaatataaaatattaaaatctgtccaaaaacgtgttccttgctggtaccctacacattgtggcctgcttcctgggtgatctggccccaggtgggatgctaatcccaagtcccctcccagcacagcctcagcccatctttcagggagaactcagctaccaggagcctttcatccacataagcttgatgcccatccaattctccggccaacctcctgagcaggggcaggagacccatgggaagtctgctcagatcactaggcaggaccaccctggcctccggcttaatcttagcagcctccaggggctcacctgaccgtgctgtctcatcacagggggcccccgaaaggactcatggcttggcttgcccagaggcttccatgggacagttaaaggctaaaatgggaccccccaggcagcagaagtgcctccccccaccccacattccagtttttaccctgggcctgacaacacaggaagcaggctccctgccaacactcacaccctctaccatacagacacttgcccccagtctctggtcaacactctctcacagggtcctcaccctcatcagcccaacccctgctctgtaacagaagggagctctgccaggcggagcctccacactcagagaacaaactacagagtcaaggacctgccccaagtgggtgccatggggagagggcctcggtggcggggggaggctggctggaggaggaacagaatggcagagccctggagtccaaaggccctggctgacagaactggcaacacgaagcctcagccgcccttcccaacaagcctggggccctgacccaccgagcaagactcctttcctggaggagctgccactctctaacctctggctctaactgagccccatcagagacagacagtcaaggctgtagtctgcagacacctggctggagctgagggcacagcagcccctcgaagcagcgggtgagaggacttactggctatgcagagcagagtgtggaagagccacatccttgctggagcagaggcggctgtgtgggagccgaggcgagtgcgacacatgggccgtggcccactcagcttcccctcagccaggaggccaggaggcggggacagaagcacacacaccagcaaggacccacagaccggcactttcaaccaaacagagacactccggctcgtacacaaccagccgtgtggcttcctcagttgtgggctggaccctaggagcttaggggccactgtcagccccactctaccacccacactttgacccacactttcatggaatagggagctgaggtttggccagggccacagttctaggtgtcctcagcagatgctggaggtgcaggagcaacgtgaatccagcctgccgttcgtatcatccatttgagtcggtcccctgtcctgcctcagaacctaccaccagacatctcagcccagcttccagcccagggtcctcggtggtggttgcctcagcactgagacaggcgtccccctcccataggaagtgcctccccagccaaaaactgggctcttgtaccagcccatgcactcaaggccctggggttctggagggccaggtgagtggaaagacccaacgcactgagtgaaatcactgcctcgattcaacttcggctgcgttcattctctttaaaaccaggacagcaacctgacgtggaaactgactgaacaggactctgagttaccagaataacagaagtaaaattctatacatcttccagcatacctgtgatgcatcccagcattccacagaacacgccgttgacagctggcagtcgtgtttaagtgctgatctgagatctgtactgtgtgaccaagtctgtgacacagaaggaactctcctgcacccctgctccccaggctgctggaagtgcagagtggcgccgtcaaacagaactctgcgcggggatggaactgctctaggtcgacgctgtccaggatggtactcatgagccacatatggtactaaacccttaaaatgccactagaacaactgatgaactgaattttgtatattttatttaattttaattaaacgtaaaaaggcaggacattccaaggctctctaacacgagtgtctgcagccccattcgctttgagatgtgaatgtgttaacccagggtggacaatggtgttgacttcattactagataaaaatccatgttattttgtttctcgcattgaaaggctgcttggctaaggttctgtgaagatccgatgacatttccaacactttgccttgtctgctttgctctgacaaagtgcttatgactactagatcttgctcggttatgtgagattacaattcaccggtttccatcctgtatgaaacagaagttaaacagttgtaaaagcaaaattccaggtctggtggttttcctgccaggtcatgatgaaaccatcctacttctgttgaacctcgtcccaggcaggatcggggcctgcggcctacagcctgtcttcccagcgctccagggctcgtgaccctcctcctcccctcacttcattctgcgctccaagggcactggggagagtcacagtggtctcctctcccccgcattggcctaaagcaggaagagagcagcccagtcactgagcagatccctgctagggcagggctagaacccagactgcagctcactcgagattcctgagagaagactttgtgtttggagtgtgaacgtcagggtgcctcgggaagccagggaaagctgatgactgggtgctggacagggagcagggccacttctgtacctctgcacacttctagaatgcggactcatcctgcatccatccagtatgtatttatccaagcgtcactgcctctagtcatgagacacacaggggtccgtaaagcccacctggcggtagctgctttccccacaaacccaaactacatccccaaggtcagggccaggctctgttgagtaatgctccccatcacagcacgcagcacaaggctggctgtttgacaaatacacacataaccaaaagacatgtgaatgtggtttcccaactcactttaaacaaatattccgggaccaacttcaaggacgttctacaacagaaactggactgtactcttcacaaacatcaatgtcatgaaagacagaaaggctgaggacctgctccaaacgaaaggaggctgcagagaggacaactaaaggcagcgcttgatcctggattggatcctggaccagaaaaacaacggctttcaaaatcattattgggacagttggcaaatttgaaacaggaactacaaattagcaactcctgggctgatcagagaatattacacatttcctgaatttgagaactgtaccatgggcatgtgagaggctgtccctgttcttgggaaatgttcactaaaacatcttacggataaacgagcatgatgtatacaaataatcctcaaatggttcatggttcagagaggataggaagaaacaggggtgagggagaagaggagggaacgaatgaaagagaaaatgtggcaaaatgttctttgttgtacccttcaaactgctgtgattttgaaattatttcaaaataaagttttaaatattttaaaaaatttttttctttctccccttgataccaggaagaataaagtttttaaaaaatgggcaggtgggccaggcgcggtggctcacgcctgtaatcccagcactttgggaggccgaggcgggcggatcacaaagtcaggagatcgagaccatcctggctaacacggtgaaacccggtctctactaaaaatacaaaaaaaattagccaggcgtggtggcgggtgcctgtagtcccagctactcaggagggtgaggcaggagaatggcgtgaacccaggaggcggagctcgcagtgggcggagatcatgccactgcactccacttgggtgacagagcgagactccgtctcagaaaaagtggccaggtgcacttgtagtcacagttacttaagaggttcaagctacttgggaaagcttgagcccaggagtttgagtccaatctagacaacatagtatgaacctgtctctttaaaaaaaagttgcaaaatgttcatggatggaggagacgtgctcggcgtgaggtgaaagggctgcctgtgggtcgggcgtggtagctgacacctgtaatcccagcactttgggaagccgaggtaggcggatcgcctgagttcaggagtttgagaccagcctgggcaacatggtgaaaccctgtctttactaaaaacacaaaaaattagccaggcgtggcagcgtgtgcctgtagccccagcttcgggaggctatggtgggagaattgcttgaacctgggaggcggagggtgcagtgagccgagactgcgccattgcactccagcctgggcgacaagagcaagacttcatctccaaaaaaaacagaaagggctgcctgctgtcttcagagtgagtcaaaagcactgaggcacagccttcagacacaggaaatggttctattctcccacttgccttctgactcttaggaagccagaaagagtgacggcattgctgagaccagagcccagggctgcagagcagtggtactcacgacctttgaacactcggtaggagtgccctgctcagtgccaaggcctcacatgcgagccctcatctgagcctctcagccacctacaaggtcaacccgatttctcagataaggatgctgcctctgagaggccacatagctagtaaggagcagagctgggactccaaacaggcctgtttcctccagaatcaggactctgaaccaccacaaactctcctgccttcagctcttttggtgtgtagactttttttatttttgtttttgagatggagtcttgctctttcatccagactggagtgcagtggcacaatctcagcttactgcaacctctgcctcctgggttcaagcgattctcctgcctcagcctcccgagtagctgggactacaggtgcccgccaccacacccggctaatttttgtatttttagtagagacggggtttcaccatgttggccaggctggtctcgaactcctgacatcaggtgatccccgcctcggcctcccaaagtgctgagactacaggtgtgagccacgtgcccagctaggtggtgtgtaaactttaaaaaagcagagatttcatcccacaaatgcagactgggatctccacatgaccaggtgctgtggactgaactgtaaatgtcctccaaattcatatgttgaagccctaacccccaatgtggctcttcttggacatatggcttttaggaagtaattaaggttagatgaggtcataatccagcaagattggtggccttacaagagccatgtgcaggcaccaagaaaagcctacgtgaataagacagcaagagggtgctcaccatgttggcatcctccggcctcagatctgtgggggactgcgggggtgatgggacagggagagaacaaggagtggattttcttgtcctttctaaggaaggggctgggagggcgagggctgcactgggtgctgggactaagggtccaggggcttggatctcttgtttacaaacccctacttctttcctgctatctagcccacacccctgatgctccccggaaaggagagcaaggatccttgaacacgcgttagcactagaaggaaactggagctcaccccagttgagccctccatttgacagacagggaagctgaggcccagggaggtgaggggacttgctcagtctttccaattgagtatgtggggcagaaggagtccccagagccccggccccagccaccatcctatttgactttccccaacaggcattctacctcagctaaagatgctgcctgcctctcacaggccctgaggagaagatggccacatcacaggatcgaacactaccacaaaactcctaggaagggacaggaaggtgagaatcctttcttttttttttgagacggagtctcgctctgtcgcccaggctggagcgcagtggcgcgatctcacctcactgcaacctctgcctcccgggttcaagtaattctcctgtctcagcctcccaagtagctgggactacaggtacccaccaccacgcccagctaatttttgtatttctagtagagacggggttccaacatgttggccaggctgctcttgaactcctgacctcaggtgatccacccgcctcggcctcccaaagtgctgggattacaggcgtgagccaccaagcccggcctgagaattctcttctgtcaatggtgtgggcctctcgacctcactaacctatattggcccagaggtgatggtgacaatttgagataacacaaagtctcaactatttacgaacctggtcatccagagagggccccggaattgctcaaatgaacagtaagaatcctgaggcagggtactgaccttggtaggtgaaataccgcctatactctcaagttttatggatagtgcagccaaattccactcggatgcctcacaactacttaaaattggctttttgaagcagcatttccctaactactcccaggaacaaagttctgtgaaatgttcatagagcttcattgaaaaaaaaaaaaaaaaaaaagctacaatatttttcttctaagatttattttataaacatgtaagaaaagttgtagatatttattgtgggtctggttatgcaagaacaatcttcctggacacagtgtgcgattctcagtatcaaaagcattctcttctttcagttcgtaaaagaaaaacatggtttaacttctaatttactgcttattataaggtttaaaagcaattactgtacttatgtatcgaacttatttgtgtagcaactaattcatctgtgaagccatggtttgctgtggcttcacagtaaattttgacttaagtctaaagcgtgtgttagcatctcaccgtaacttaatgcttcgagtgagaagtttgaggaatgctgctttaggcaaaagagccactggaggaatgagctctgctcttttcacctgctctggactgctctcactttcctcaccgacaggaccacaggcttaagaactggctcagcagtccttctttagggtctagcgcctgcctaccagcttcctctacttctatcccgggacagatgaatgcttttctaaaaaatattttggaccatctgcatgattccctagcaaatgctttagagagctggtaagcttcagctccgacatggccagatcatcaaaatttgaagtttactcaggtctatttaatgagatttttttttcttatacaaccatatgcacttctgaataatcttccctttttcgaatctggggctttcatctggaattagactaacctgcagacagtgatgccagaactgggctgggttaccataattcattcatttaccaaacactttcgaagcactacttactctgggctggcctgatgaaaggatacagagataacaccacaaagaaacttgctcattaggagcttgcttactggctagaaaggaaaatacaacatgaaaataaagcattgtacgtacatggcagaaaaatgactagcctgccagagggccccagagcctcagaggatggagccactcctgaggctggagggtttacaaactcatcccatctttacagaagacctgctagatgccaggcatgctggcaggcacaggggaaagcccactcaacaagcagacacggtccctgctctcacggagcttacagtctagcaagacaaactaggaacaagaaattacagtccagtgtagaggtgtgcagggttgtggggtacagtgatttggcattatacacacatttcgcttaaacacaatggtatttgtctgaaaaagatttaaaaaaagaaaaacaaatcagttgtttgggccattccgctggcccctccttcactccatgagcatagacaagagggcgggcccgggcaagctcatgcctctgctgcacctgcggcctgcctcagttcccaagctccccaaaagtgatcttctcgcctaaatgtggttctaacaccccaaaacaagtgatttttgcacaacacagccctaactgcaggccaatcacttcacctggtactcaaccaaacagtaatgtgttcccacatgggcaagaaatgactacatgggacctcaagatgttggtcttcaatagggcaccttccttagatttctaagaggaattttaattacactccatttttatcttaggcactgaccttagaactgaatcctggagagagctgagactcttctgtggcagtaccatgggacacatagaagtagcctataccctggctctggaagttggggactgcctcctagaagggcccctaagaccttaagttggtgaggggaagattgaggcgggagggggagaagcctgggcggaagcatgtcactggaggtagaaacagctctgtgcacagtctgtagggctagtgagatcaagatacatttagggaactggtgagcagagggcaggggagatggggagaacaggccagggatactgccagaggatagaccttggtgagcctcataacatgctatcaaaaagggtggaatttatgtatgtatgtattttttgagacaggtcttgctctgctgcccaggctggagtgcagtggcttgatcatagctcaccacagccttgaattactgggctcatgcgatcaggagtgtggaatttattctcggggcaatagtgaagctttggaaaacgttcaagcagaggaataacagaatcagatatatatttaagaaagttcatcctgaagcatgtgaaaaggtgcccgacatcattagtcattagggaaatacaaatcaaaaccacaatgagagccaggcgtggtggctcatgcctgtaatctcggcactttgggaggtcaaggcaggaggatcacttgaggccaggagtgctagacggcctgggcaacataacgaaaccccatctgtacaaaatgtattttaaaaagaaaaaataaaaacaaaaaactacaatgagataccacttcacaccagaaaataatgagtgttggtggagatgtggagaaactggaaccctcgcacactgctggtggaatggaaaatgatacagctgcttggaaaaaccacctggtggttcctgaaaaggttaaagataattatgactcagcaattccactcctaggtatatacccaagagtcatgaaaatacctgtccctgcaaaaacttgttcgggaatgttcgtagcaacactattcataatagccaaaaagtagggccaggtgcagtggctcacacctgtaatcccagaactttgggaggaagaggtgggcagatcacctgaggtcaggagttcgagaccagcctgaccaacatggtgaaaccctgtctctactaaaaatacaaaaaattagccagcgtggtggcacatgcctgtaatcccagctactctggaggctgaggcaggagaatcgcttgaaccccggaggtggaggttgcagtgggccgagatcgtgccattgcactccagcctgcacaacaagagcgaaactgtgtctcaaaaataaataatagaaatagaaatatatatatatagccctaaagtagaaacaactcaaatgcccattaaccaatgtggattaaaaaaaaggtggcatacccataaaatggactattatttggcaattttaaaaaatgaaatactgatagaagctatgacatggatgaacctcagaaatatgttaagaagccagtcacaaatagacacatagtatatgatcccatttatatgaactatccagaacaggcaaatccacagagagagaaggaagatcagtggtggccagaggctaagagggaagagggaatagggagaattgctaatggactcagggtttctttgggtgatcaaagtgttttaaaattgattacggtgctggtgcataactgtaaatatactaaaagccactcaagtgtacactttaaatggctgaactgtatgcaaattacatctaaattaagctggtaacaacaacaaaggttcatcccgctgcagtgtgcagaatggagacagggcagagaccagtgaagaggctgctgtacaaatgcagctggaaagggcagtggctgaagaacggagaggggttcacaggatcagactacaagggggccagaggaggagactacatcctgaggacgccacaaattatcctgggtacctggtaactctccagagaggagagtgggaaacaaatgaggtatctgcaattatcatcaagcagcaaacatgtatgtaaaatctcctacacataagactaagaggaacacacaaagtgtgcagccctgtgcccacatgtgtggggagtgtccagggtaaaatcacgcccagctgcctgccacgggcctgtcctgactatccattcttactcttaaactccaaagaaaaggcctcatcattcaggacacactcaagatgttgcaagatctgagtgactgagagtgggcaggagggttagagaaactaataaggccagtaactccgagaagtaaaaatctttaaagctgcctttctgggttctctctgtgtgtctgtgaaaactgtaaggttactcgagtgtgtatttctcttggttacatcaaagacccagttttgactgcacaccacctccttccagaatggcttcgctgatctgtagcaggagactgctgagtgctgaaaggccgtggaacaaatggacctgagctgctggtgtaaaaccaaaaggaaagtctgtgaaggagcatattctaaaccctgcagaggcatgccagctgggacgctgaccacaagacatctttgccccgtcagtagaagcagagactgtgctgggatgggaataagcccctgtctacacctcatgcgcgccctcagttgtctccctggcgcctcctccacctgcagtagaaattcatgctggcgagcccactgccgtcacagcttgggaagagtaaaccgccactgagatgcaccaacaaagccaggaattctggtaacagcccactcaactgctagacgggaaaactgaggcccaggtccatggagcagagccaggggttggcatccaggtgtccgattctcaggcccccgcactcctcactctaccaactccccaaaccctgacccttcctaagaacctggctctcagctgtatgcttcacagggaaagaaaagctgagaaatctcagatgtcttaagtctcaactggcagagaaaccagaaccatctctttcctagaatcctaataagaagctgaaatatatcatggttatatcctctaatctctctaaagggagggagaaaaagcaaggttaatcaacaaaatatgggacaatacagtttttgttgcagctctcaaatcttgcagccctttacttcctttattaataacagtgttctgcattaattcgtgccacagtgtaatcaactatcaatgtgaccattagctccgccacaagtaaagatcgacaggatccaggctgcactgtgtgcacaacagcccaggcaggtgaagagtcgtgacatcgcaaaaaggaccacggtttattaccatctctaacgcccatgttccagcaaaccgaagaaaaacactgtttcttaaaactgcagaggaatacaaaattaaatactacaaaacaaaaatcagacaggaagacgaaacaatctacctcctcctaatggtaaaataatctgaaaggagtttaaaaataaatgaactaaaatttttataactattatcttttctgccaattttgaagatgtcttcaggtgccacaacgtggggacagaaagaataaatatcaatgtataacttctagagtgataataaacaacaggaccccatctcagatggatggattttttttcctactggagccaaaaaacaagctgaactctatgtacaacagacagactatacaactaggagcatttaaaaataataagactcctctctctgccttcttccaaagaatagaatatatatttaacagcacaaaagacgacaccacttgagcttcccctttagccaacaggaagaatttccacatataaaaattaaaaatttaaactttcaaatcattcatgttttaaacataatacagacttaaaaattcttcaacattgacccataatcccaccccagcacaaaaatcaaccccaaatccagacgtcacagttttttgttcctaaaaatcccacagcactgaacttgatcttcacatcaagctgacagcacgtaagaggcccatgccatgagcaatccccgagggaagaacggaagcacagtcaatgctgcagctcttatctacctgggcggcactggtgcacctctgaggtcaggtccgtgagattcgccccacactagggtcccggaagggtgagctggccgcttccctcctcttccccctcgaaggatgtccaataagcacctgggaattgacttttcttgggaaaagggtgctggtaacagctgtcagggccaaggcaatagtgagaagttcagttctctgctctttggatgaactgtgtaaaacatttcttttaaaagacacaatgttaaaaatattaagaaaaatgtctacaaaatctggagggctgcctttttctcaaagggtaaagcctgtggggtggtgggaaaggaatcgagggcccagaactacaactctgcagcgaaagatagagatgcccttgaaaatgtgtcacattcttaagatgtcttgccgaagtagcaagagcggagggtgactgtgtgagcaggagcgagagggcgccagctcctgcgggggaggttcctactgcgcgccccaccctgtgcaagaatgtcaggctttagggcagctgccataggccccaggggcatcaggactctgcctctgaaccagagctgctttcccgactaacttcaatctggagagatggtaagttatctaaccggctcttcttttggcgagactgctctttctccttaatcagagccccccatgccctttgcagctcagagtcgtcttcctcagcgccaggcgccctgtgatccactttcttcgtattcttttctttggtcttgggtgcagatcctaggcgagtccataaattacctgtttggatgagatggcatttcactttcgcagtcagcgctaagaaccagggtagcactgagggggcagcagcactgccaacacctgctgtgcaggaaacgccagcagtctgtggagcctgccaccacagtgcagccttgggcaggcaaaatctcatttcccgggccgcagcccctgcccgcaaacggaagggtctggacccagcacgggattctcaccgtggggggacaggtcaggtccctccctgtcaccagacacatcagaatcacctgagaggccgtttcctcctactcctgcccttccctgctgagacaccaccctgtgtgccaatccattctgccagaagtaggccactcccagatcccttccattaatttttgaaatatattttatgaaaatttaacaatagagaaatacgtgtttagaattttgtagacggccacattataaggcaattcaaagttgtttttgtttttgtttttgagacaaggtcttgctgttgcccaggctgaagtgcagtggtgcaggcgcccaccaccacgcccggctcatttttgtgtttttagtagagacagggtttcaccatgttggttaggctggtctcgaactcctgacctcaagtgatccccccgtctcggcctcccaaattgctgggattacaggtgttgagccgctatgcctggcctaaaagttttatttataaagattataaaatgtggcaaacaactacgataaaatgctgtatgaaaaaactaggatttgtatgtgggcaaagaccagaatagctcacatgaaactaaaaagatttgtgccaaacagaaagagccaggagtgtgctatttttttctattttctaagcgttcctaactgttgggatgatgctgatgctgatgctgacgataactataatggaaaaggaataatcacttatatttggcgtgggctgtttcttgccttctgctaagaaagtatttctccaatacacccactgtcctctgctctcactgaatccccattcccatccgttttaagtgttaccaacctgatttcttctcccgagtatcggcgtagaggcctttactatcctgcctgggaacacctagcctactatgcacatcagaagagggctctctccgaacgacggggttactactaaaagccttttccggagaatgtggtctttttcctaaccgctggcgtatatctgaaaaaagagaaaaagtgcaccagtgaccgtgtgtgtgctttatgctcggcaccagccgcctgacacctctaacggatctggcgctaacccctgccccgaggacacagggcctgacaatcaggctgctaagtattcttcctttgtaatcagtctggatttccttaggaaaattcggacataggggctgtcagaggaaaaatcctcaactgattactccagaactatatttctgaagaaacaacctttttttttttttctttaagcagaatcaagaagactaagtaatttacaaaagtttcagcgaacaaaaaatcctgtgagctcctggaaagtggaaggcacaatctttgaacatacaagtagttcccaataaacttattacatttaaccagtaaatataaagagactggaaaaggcaaaggatcaaatgtgtttttccctcaatccccccagaaatcggcctgtcctcttgagttccccctaaccaccacagcaacaacagaaacacattcgttggtgaggccctgtgccgaggtctcctctcactttagcttctctcagagagcagcaccctggtctctggtcactgagacctgagctcctttcctccaacacttcctagcactgagtcttccttcacaagactatcctgttctttatccattctgtctccaccgacctagttcaggctcttgttacttttttaactctctaccccaccccactccaccctcaagttgtctttctaaaatagatgtaagatcaggttacttctcatgtaaaaaaatcaggtttgccaacagagatcctaccctctccaaggcctggctctaatgctactttctctaagaagtctttcacaacttcccgagtagatctatgacggctctgcgtcccctccaaaggcttctcacattcctagcacctagaccagggtctggcacatagcaggtacggctaaagacctgctgaatcagtgtttgaacatagaaattatctagttcaaactcttaactgttcagacaaccaccgaacttaatttctattattcttgtatataaagtataccagtgtcatacagaggaaaatatggttggccctcctcatccatggattccacatctatagattcaaccaactgctgatcgaatacatgtggaaaaaaagtaagacataagagtacagcaaaaaataatacaaattttacacaacacaggataagaatttataccgtattaggtattgtaaataatctagagatgacttaaagtatatgagaggatgtgtgtaggttatatgcagataatatgtcactttatataagggacttaagcatcaatggattttggtatctgtagggggcggggagggggtcctggaagcaagcccccagacataccaaggaacaactgtaattatttggaataaaaacatttaaagctagtttttcagaagtctgattatttttcatttcctcaatttccaacacctagcccacaatttagacatgatgaaccaggacagctaaatcagttcacacatcgcatgttttactcaggaacctctctctgccccagtctgctttccggagctcagaatccagccaggaatccaagtgaggaacagtacctgatttagtactgctgactggtggccgtggacgggagtgctgacgtttctcatctaatagatgtcggacatctgcaaatttctcaggtggtaatttgttaccaattcggtttttgatattgcttgaagatacactatctgccctcatggagttcctttaaaaagggggtaggatggggcacagttaaccaacttcaactgtgagacaagacccaaacaacaatctcatactttggaggaaacaatttaagaaatcctgtcttacatggccaacattcacttacaaatccataaacttataattatttgcttatggaaaccatgatctgcctgctctaaagagactggttctggtgagcaggttttcgaaggtggtttccacatgtgtatgtgctattacacagcatacaactacaagtcccccttttctgggacaaacgttaagtagaggcctacaaagagattggggcttccacttacacatgctgtgatgtggctgtagtcaacacacagtatagtctacagtctctctctttaaagggcagacttctctttcaaagagatatgctatcatgctaggtgccagcaccgttccggcagcattctctaccagaaagctctctgaaaaccaaaaataagaatgtgaacaggctcatgcctgtaatcccagcactttgggaagctgaggcgggcggatcacgaggtcaggagatcgagaccatcctggctaacatggtgaaacccagtctctactaaaaatacaaaaaattagctgggcgtggtggcctgtactcccagctccccgggaggctgaggcaggaaaatgctgtgaacccagaaggcggagcttgcagtgagccgagatcgtgttatcgctccactgcactccaggctgggcgacagagcgagactccgtctcaaaaaaaaaaagaacgtggtgaacaaggccatacaaacaaatcagcttgaatggtcttttcccctccccacaaacatactacgttacacagagcatccctagactctaacccttagaactgtggattctgcctgcacagaatctgctcacccctagtagtaatcaaagacatgcacattaaaataactattttttttttgttcatgaaactagctagcattagaaagaatggtaatagctaaggctggtgagcttgtaggtaacaggtggtaatgtgagtgattaaaacccttctgggattaaaacccttctgagcccgggcatggtggctcatgcctgtaatcccagcactttgggaggctgaggcaggtggatcacgaggtcaggagattgagaccatcctggccaacatgctgaaacccgtctctactaaaattacaaaaaattagccaggagtagtggcaggcgcctgtagtcccagctactcgggaggctgaggcaggagaatggcgtgaacctgggaggcggagtttgcagtgagccgagatcgcgccactgcactccagcctgggtgacagagcgagactccgtctcaaaaaaaaaataaaaacacacaaaaaacccttctggaaaaaaataaagcaatacttaccatctttttaaacacatattgttttgtgtaataactggactttgaggaatttattgagttagtgcaattgtaagaaaatagaaacctaaagtccatcaaaaaggaattcgttaaataaatcatgatactttcaaacaacagactatatacagttgaaaaaaataatgtctacaatatattaagtgaaaaatgcacaatgcaaaactataaatagcataacctcatctttataaaaagtatacttttatacaaatatatctacagcttttccctgtgccatacacacacacacacacacacacacaaatagctgaaaggttattcgccaaattgctaacagtagttattgttgagaaagaatgggaatacagatgattttcactttctatgttgtcttttgtttttataacaagaatcactgcttgtatagaggaaatactggatgcgtttattaaactcctacaagggactgaaatcagaatagataaaagatattataaaattaggaggaattaagaagttatactagtatttaaaatcaaattaaaagctagctttgataaaacaaatttttacctaatatttttcaactgagattccacttcgtcagcatacatagtcattttcatgcttttctttggtgaaggcgtggaaatcattttcagttctagatcatagtccatttcatctgagtctgagctgctggcactggatcgtctagacgcgctccgctcccggggctgcttgagagccgggagctcctcgtggtactctaccaccactctgtcatctgcatccatgtcctggtcttcttcttcctcttcctcttcctcctcctcctcctcttcctcctcttcaatgggttcctcgggaacattcactagccctgaagaaatttaaccagaaaacattaggaaaagcactaaaattaacaagtatgattttctactctacatcggtgacctttttaaaaggtggggttcccatccctgacattttattggagcactatctataatagtgccaaatggacattactctgatactgcaacaggaggatggctaggtaaagtatgatgcagcagcctaaccaaataccataaagtcatttaaaatacaactgacctttattattcacagattttgtatttgcaaatttaccaaatttatttgtaactccaaaatgaatacgtgcaatgcttccatggtcatttgctggcacgcacagagtggcaaaaaaatctgagtcaccaggcacacacactcccagtggaggtcaaacaaagcaacactccaccttcctgtttcatctcatgctgtaaacaagcgtctgtttcagtccaccgagtggcacatttttcacacttctgtgcctgctgctagtgatttcactgcttaaaatggccctgagtgtcgtgccgaagtgctgcctagtgttcctagatgcaagggggctgtgatgtgccttgtggaaaaataccatatcaggtaaggcattcaggcatgagttatagggctactggctgtgaactcaatgttaacgaatcaacaatgtgtcttaaataaggtgtcttaaagagaaacatatgggcccagcgcggtggctcacgcctgtaatcccagcactttgggaggccgaggtgggcagatcacgaggtcaggaaatcgagaccatcctggctaacatgctaataccctgtctctactaaaaaatacaacaaaaattagccgggcatggtggtgtgcgcttgtagtcccagctactcgggaggctgaggtaggagaatggcgtgaacccgggaggcggaggttgcagtgagccgagatcgcgccactgcactccagcctgggcaacagagcaagactctgtctcaaaaaaaaaaaaaagagagaaacatatgtaaaacaaggttacatattgatcaactgacaaaaatgatgtggccagaggctatgtacgattcagtatttgctacttcagtgttcacagtgactttatagaacataagcaccatgaataatgaaaatggaaaaatacaataaacgaaagaagtagaatataaagtacatgttcccaagagttatactatttattatgaaaacaaatgggaaaaatgtaagatgaactcagtcatcatacagggtactagaaataggggcaatttgctttttaatttccttaatatggatataaaaagtatatgatgaaaatattttaaagtaactcaaattggaaaagtgtaactgtgtaacagtaaagtatgtgtattattattattattttgagacaaagtcttgctctgtcgcccaggttggaatacagtggcacaatcttggctcactgcagccttgaccttccaggctcaggcaatctcagcctcccaagtagctgggaccacaggtatgtgccatcatgcctggtctggctaattttttaattttttgtaacgacaaggtctcactatgttgcccaggctggtctcaaactcctggtttcaagtgatcctcctgccttggcctcccaaagtgctgggattataggtgtgagccactgttcccatcctatgtgtattattaacatgtagatctcaaatatacaattttgtatatacacattaaataaaacatctagacttcatccctttctgtccccattacaatgataaatgtgtgtatatgttattttgtatgctgacttgactagttctattaggcatgtagaagattccatagattaggctcaaaacaagaacaattctttataaaacataaataaaatggttcttttacaataagcaccaaaaaaaggagaaagaaacccaagtcatgatatcccactcttctgaggc

SEQ ID NO: 1114 - DNA, 78870 bp, Homo sapiens
ttttttctttctttcttccttccttcctttctctttcttctctctcttttctctctttttctctctctctttctttctctcttttttctctttctttccttctttctctctctctcttcttttctctctctttcccttccttccttccttctctccctccctcctttcttttttttctttctttcttccttcctttctttctttccttctttctttctctctctctctccccttccttccttctttccttctttccttccttccttcctttcttctttctagattcacaactgtttaatatgtataaaagccaaggaaaggacagtcctagttcaacagaaatattttgtataattcatatggtgtggttgagagggaaggggaagaggttacagaacgcacacccaacatgtacaagattaatttacatagcaactgccgcctgcagggaggatgtagctctgcacagccccccagggctgggcacattacagccacagtaccgtgggagccagccagtgtaggccccaggtgtaggtgagagtgaggagggcaccaggccagaggagagggaggatgaggaggcagttgaccgcccagcacgagatcagcaactcatccatcacagtgtgggcatagccacgctggcttcccagctccttgtggctcaggaggtacatgcggaagtcctgtttctccatgtaggtcacggctgccatcagtgggcacaggatgcgtttggtatggccctgagcttcacacgttttcttctcagcagaggaagggctgcctcacatgaggatgaggaaggagttgcactccaagacagagcaccaggcccaaccaggctcaagtgctaggagggccgggcctgttgttctttactattaaggcctcagcatccagagaagcacctggcatgctgcatatgcttagtacatgcttatgaatgaatgttgaatgccaaggctgagctcatccctccacaacttccttgataaaaaactagggatagttttcaagtagctccccagagcccataaagtccaggtacgccatttttagtcagtgtggactctgaaaagcccattctcctgtaagccaaaagaacagctgggtcatccctttctcaatggacagaagagtctctgccaaatgtgtaggaggagaagattctgagccacacttggtcttctctgcagtctctctacaaataacaataataataacacatgcctctgtgctttccagattccaaagggctttcgtatatccatggtctaatggaacctcatatccatgtgtgtgtgttgggagggggaaggctaaaattgggggtgggaaaaaggcaggaaacaggcagtgtattttttacagataaagaagatgaatgtagagaggatttggagactttttcaaggtcatctaactagtaaaagatgaggcaaggatgtgaatctagaccttttggctctttgtacaaaggggaattaaacatgaccatgaaggtaagaggttcgagaaacggccacaaacctggccacaaaacttatagtggtgacaataaggaactgaataggagcaggagctgccccgggttggggcagactattaatgagaacacaggaaaagcatacctattttggtatcagcctggcacagtggggcaagggaccagataatgtgactcttgccttgtaaacggatcttgggaaagatcttccacctgccatgcattggatacccctccctggtcctatctgctagggagcatggcacttgggcaaatcaaagagtggacactcaggtctcccaacatatgtgctggataggtagtctgttaaaatgaaaacggtaaacaaataggaagatactcttttatttgttgagagcttgctaggaaatataaataagtcctggcactcaaaacatcttgctgtccagtattggtagaagaggtggaggtaagtaaataagtaatcacagaacctttgcttttggctatggcaaagtgactagtatgggacttgctctcccacaggaaacaacaaaacattttgaaaaaatatttaaagaactccttttagaaatggagcaataggcagagcagaattataatccttgaaggaagagagaacacatgagctcaaccctatatctgcccagctttctgcattgggacattttctgggttgcactgcaatccagaagctcaagaagtacatgttggtctcattgggcagaagaggcatagattagaattcagggctgctgaggaagatgtaatttgcaaggaaggcttttagagaggaaggaactgaacacagaggtgctcccagaagtttgcatgggtgttctgcatggtctttggatgagggatgggctgatatacacagggtgagactccctaaggtttttcagagagcagctgagagctgaacaggtcactagaggctgtacatggcttgcagatgttggagtttcggcttagccagaatgaataaatctcattgagcaacttgggtcctcagattacactccagaaaatccatgccttaggaggaaggaccacgttcaatagtaaaaaaacactccttgaaggtatacaagaagcaaataaacatatgaaagatgctctacatcatatatcatcagagaaatatgaagtaaaacaataataaaatgctactacacgcctgttagaatggccaaaatccggaacactgatgtccacacaaaaatctgcacatagtgtttataagcagctttattcaaaattgccaaaacttggaagcaagatatcctttagtaggtgaatgggtaaataaactgtagtacctccagacaatgggatattattcagtgctaaaaagaaatgagctattgagccatgaaaagacagggaggaaccttaactacatattactaagtgaaagaagccagcctgaaaggactatacactatatgattccaactatatgacaatctggagaaagaaaaaccctggagacagtagaaaggtcagtcgtttccagggattggagggaaggagggataaatatttagagcacagagaagttttagggcagtgaaacgattctaggggactataatactataatggtagatacacatatttataaatttgtccagccgggtgcggtggctcacgtctgtaatctcagcattttgggaggccaaggcgggcagatcacctgaggtcaggagttcgaaaccatcctggccaacgtggtgcaaccccgtctccactaataatacaaaaattagctgggcatggcagtgggtgcctgtaatcccagccacttgggaggctgaggcaggagaattgcttgaacccaggaagcagaggttgcagtgagccaagatggtgccactgcactccagcctgggcgacacagcgagattctgtctcaaaaaaaaaaaaaaaaaaattgtccaaacccataaaatgtataacatcaagggtgaacttcatgtaaactgtgaatgttgggtgataatgatgtgtcaatgtaggttcctcagttgtagcaaatgtaccactctggtgggggatggataatgggggttgctctccatgtgtggcgcaggggcgtgtgtgggaactctgtgctttccactacattttgctgtgaatgtaaagctgctctaaaaaaaataaagtatattaaaagttagagttaacttgaaatgacatttgatgaaagaaatagattctggatccacacgttttctatgtaagaatattcttttggctaaaattataatttagaaacaatgaacaacaacaacaacaagaagaacaagaaaccacactttaagaccaaggataaaatttaaaaaggccatttctgatgaagaataaaactaagcctgactagatcaagacaatctggtactaatttaacagattatttatttattcatttatttttagagacagggtcccactctgtcacccaggccagagtgcagtggcatgatatagctcactgcaacctcaacctcctgggcttaaatgattcttcttcctcggcctcccaaactgctaggattgcaggcataagccaccatacttggcctaactgcttaataggacaaaactcaatactcttcaagaaaagacaacgtaaactcaaaatcagtagtccacaatgtttcactataaaacctaatattactagacatgtcaagaagaaggaaaatgggatgcataattttttttgttacttttttttaaagagatggcatcttgctatgttgttcaggctgtttaagagatggggtgttgctatgttgttcaggctggtctcaaactcctggcctcaagtgatcctcccacttcagcctcctgagtaactgggattataggtacatagggacccataatttttcctgaaaaaggaaatcaatagaaacaaaccttgagatgaactagaattagcaaactagaattttaaaacaactgctgtaaacatgtttaaggacttaaagaaaaatataggcataatggttgaagagatgggggaatatcagcagataaattgccagtatagaagagaactaatggaaattctagaacttacaagtataatgtctgaaaggaaaattctcctggataggcatcacagaatattagagactgcaaaagaaaggattgagaaacttaagagatatcaatagactatttaatctgaaagacagaaaaagtaatttaaaaaagacctaaactgcagtggtttgtggaataaaatcagatagtctaaaatatgtgtaattggagtttcagcaggtaagcagagagaaaatgtgtagaaaatagtattttgagaaataatggctaaaaataacctacatgtgaggaaaagtaaaccacttatatatccataaatcacaccagactgtaagctagataaataaaataaaacagcacctaatcaccttttagttaagctgctgagaaaccaaagataaagaaagagctgggcatggtggtgcatgcctgcaatcccagcactttgggaggccaaggcgggtgggtgacctgaggtcaggagtttgagtccagcctggccaacacggcgaaaccctgtctctactaaaaatacaaaaattagctgggcgtggcagcgggtgcctgtaatcccagctacttgggaggctgaggcaggagaattgcttgaacctgggaggcagaggttgcagtgagcagagattgcaccactgtactccagcctgggtgacagagcaagactccatctcaaaaaaaaaaaaaagataaagaacttaaaagtaactggagaaggctaggcatagtgtctcatgcctgtaatcccaggactttaagaggccaaggcaggaagatcacttgaggccaggagtttgagacaagcctgggcaacataggaagactctgtctctacaaagaatttaaaaattatctggatgtggtggtgtgtgcctatagtcctagatactgaggaggctggagtaggaggattgctttagcccaggagttcaaggctacaatcagctatgatcatgtcactgcactctagcctgggcaacagagcaagatcctgtgtcaaaaatgaaatgaaatgaaataaaataaaataaaataaaataaaataaattggggtcatatcacctagagaacataaatcttagaaaggatttgaaaactgtctccaaatagatagacgacatctagatgatgttgaatagagtagctagagaaaaacctgggacaatttgagcagcataataatgatagtactggattatcagtcctgcaataaaataaatatctgtgagtttatactgacataaataaacaaattttaaagtggaagagaagggacagctcttctttactgttgaatgttaattaataactgtataagaaaaaggaaaatagaaaatcactgtgaatcaaatgccacagtaataattgttgcagttaagaatcatcaatggatgataaaattagtgggtgaaattatgaaaccattatgatatttgcataaaattaaagtatcctcccattaaatatgtattgattacaaagagaaaaatggtagctttttttttgtatttttttactttttattatccatctgctaaggccctgtcattcacagaaatggtagctttatagtgaataaacctggcagacaccaccttaacaatgtgatcaaagtaataagccatatcaacatcatatactccttgatatgatgtactgagaaggcacaacatcatttttgtggtattattgtccaaaatgagaaaacaacagacaagccccaaataaacaaaatactacaaaaaactggcctagacttttcttttctttttttttctttttgagatggagtcttcctctgtcacccaggctggagtgcagcggtgcaatctcggctcacagcaacctctgcctcccaggttcaagtgattctcctgcctcagcctcccaagtagctgggactacaggcacgtaccaccatgcccagctaatttgtgtgtatgtgtgtgtatgacggagtcttgctctgtcaccgaggctgatgtgcagtggtgtgatcttggctcactgcaactccgcctcccaggttcaagcgattctcctgtctcagcctcctaagtagctgggattacaagtgcctgccatgatgcctggctaattttttgtatttttggtagagatagggtttcaccatgttggccaggctgacctcaaactcctgacctcaggtgatctgcccatcttggcctcccaaagtgctgggattacaggtatgagccaccacgcctggcccttttttgtatttttagtagggatagcgtttcgccatcttggccaggctggtcttgaactcctgacctcaagtgatccacctgccttggcctcccaaagtgctgggattataggcattagctaccacacccggctggcctagacttttcaaaagtgtcaaagtgatgaatgagaaagactgagaaaatgtcacagattgaggccaactaaggagacatgatgactaaatacaatggattagatcctggaccagaaaaagaacattaatgggaaaaaaaatggtaaaattcaaattctgtagctagatgaattgatagtattatatcgatgttaatttcctgtgtttgataattatgatgtagaaatgtaagatgtgaacgttaggggaagctgggtgaaggacataagaaaactctctttagtattttgtaactcttctgtaagtattaatgatttcaaaataaaaagttagggaaaaaaatccaggaggagaagaaagagaaacaagaatataaaggatggcagacttctcaccagagatgatggagacagcaaacagcagaccatctttaatgtacttgaagagacaagtctcaatcaatttagaagtttatttggccaaggttaagcacatgcccatgacatagcctcaggaagtcctgaagacacgtgcccaaggtggtcaggctacagctcagttttatacattttagggagacaaaagacatcaatcaatacatgtacattgaacattggttcagtccagaaaggcaggacatctgacacagggacttccaggttagagacggattcaaagattttttcattggcaattggttgtaagtgttattatctaaagacctagaaccaacagaaaggaatgtctgagttaggataaagggttgtggagaccaaacttttatcatgcagatgaagccagaggcttcagacagaatagactgttaatgtttcttatcagacttagagagtctattctatcagccttaaggtctttgtgttgatgctaatgctggtcagctgtgaggcatattcaaccaccaccccccctccaccttccccaaacctgcttcacatcatggtctgaactagtttttcagattaactttggaatgcccttggctgagaggaagggttagttcagacagttgtgggggggcttataatgttatttttagtttacaggttcttacaatttacatagaattgttcaatattaattcaacataggctactgtatgataagttaaggaggaatattgtaatacctagagcaaacacacacacacacacacacacacacacacacacatgcaaacgaggtgtagctaggaagccagtagagaaaaaaaaattatcccaaaagaaagcagaaaaagagaaacagagaaaccagccaaaaagatagaacgaataacaagatagtaaatgtaaacacaaccatcaattactatactaaatgtgaatggactagctcctttgccttccctggggctgggagtgcaggatggactcacttgcacaattatgtcatgtttgctagggcttgggctagggttgtggacttagcatacttgctgaggccagtgcccaccccaagtggttgctgacagcagggataggctaaggagacacctaagtggctggagattggttttatatatatgggaatggagcagataactaaatacttaggcagagatgtaaccaggccatgtgacctgaactttgctccagggcattgacactgctgttaaaatgcttctggcctagaggccctctgcagccaggggaggtagatggagcttcagcctgaaaacccaggtcagagggcccaagtaccctttgcagagctggcttttccccttgcaaattgctagtgacgcttcagctgatgtgtgttactattaaggtcctagtgtttgggagggtggggcaggaggtggaggattgtcagaaaaaaattacatggaaaaagatggcatctgagatgttttgaaagataagtggaattttccaagtggaaaaaggaaggaaaatcagtcagataggaaggcatggagcattggggaatgacaagtatcttcttggactagggtgggagatgggctggagagatgggtcagggccagttgtctggcatcttgtgtgtctcagaagagggtgggcacgctgcgtagggaagcccagggccactctgaaagccctaaaggggaactgatgcctctggccttgtttttatcaccatcaggactacccattgaggcaggctgcactaccagctacttcctggtgccctcttgctcatagccatagtattttgcctctctgagcttccagaggttttaagtctggggaagacccagggactcaaagaaagattggggtgggagataaggggccacagtttgggggagtcaggcaggaggcctttgaggaaaatagataaagtcccaaagcctgtgagtgtgaatttggaggcaatatgctgtgttctgaaacgttttcagacactggctaggtgcaagcaagtgtttgtagggcgaggctcttcatggacctatcactgcttacgcaagcttgggatgtggtcttgccctcaacaggtaggtagtctaccggaaaaccaaactaaggcaagaaaaaaattagtgaataataaaggactgaaccggttcagagaaggcattcagcagatgtttgccagtcaaatgaattaaagtgtgaatgaatgaaactcgaggtagtgggtgaatgtgtcccaagaatccagcgaaacagggtctcccaggaggcgggactggaagggtccggagaggggccacaggctcctggcctttctaagcacaccaagtgcccagtcgcggacccccgggaccaggatgcgctgacgacccggctggcaggcgggtcctcgtgggcgaggcgagggaggcggcgagagaggagcaatagtttcccaccgctccctctcaggcgcagggtctagagaagcgcgaggggatctagagaagccggaggggaggaagcgcgagtccgcggcccgccccgttgcgtcccacccaccgcgtcccctcccctcccctcccgctgcgggaaaagcggccgcgggcggcggcgcccactgtggggcgggcggagcgccgcgggaggcggacgagatgcgagcgcggccgcggccccggccgctctgggcgactgtgctggcgctgggggcgctggcgggcgttggcgtaggaggtgagtgaggctccggctcggcagcgtcgcagctgccccaggatctgcgccccggtcaagttgcggacttggagccggcaaacgcggagggctggtcccgcgcgtctgcgctgggaatgcgcgtgtcctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacccggggctgcgcgcgtcgcgggtggtcctggtcgggccaaggacgactggcccaggagccaaggcgaggtggggcttccgggggttgttcccgcgccttggcagagggatgccgctgtagcttcctgggtgagagcgtgcgcgcgcgcgggtttgccagtttccccacatttccaatttctcctgttacgctttctccagaaggttttttcttttccttttttctttctttctttcttttttttaccttcaacttggcttcctgcggggttgttttggagcaggatgagggctttgcctcctccagtgtccccaggtggcagcggtgcctctgctcccagggcagaccctgcacccgaaaaatctctagtgtattcggggagccatgaaaaggctcccttgggccggtgggatccttggctttgtctctggctgctgcgcacaccgtcagccgtcagggcaattggcattcggcctctttggtactggggacacaggtggagggatggagcgggcacagcccggggttgctgcccgtggtcctctctgagtccttggtgattttgcctgggctggagagaaaccctggctcctggtctgctggggccgcctctgcctcagaggatgacacaagagtgcatgtaagtatttttaataaaaactgtagtactcgtaaaacaatctacaccctgcagaagggatttgttattttattttattatttatttatttatttatttatttttgagacggagtcttgctctgtcgcccaggctggagtgcagtggtgggttctcggctcactgcaacttctgcctcctgggtttaagcgattcttctggctcagcctcccgagtagctgggattacaggcgcctgccaccacggccggctaatttttgtatttttagtagagacgcggtttcaccatgttggccaggctggtctggagctcctggcctcaagtgatccgcccacctcagcctcccaaagtgctgggaatacaggcgtgagccaccgcacctggccaggatttattttaaaaagggaagatttgttgataaattcacttcaaagataaactattcgaaaatactttagtgattcccgtcaagactcttctgtgtatgtatagacgtataactcattctggacagggcaaggatatctttttttgtttgtttgtttgttttgagatggactctcgctgtcgccaggctagagtgcagtggcgcgatttcagctcactgcaacctccgcttcccgggttcaagggattctcctgcctcagcctcccgagtagctgggattacaggcacgcaccaccacgccctactaatttttgtatttttagtagagacgggatttccccatgttggccaggatgatctcgatctcttgaccccgtgatcagcctgccttggcctcccaaagtgctgggattacaggcgtgagccaccgcacccggccaagggtatcttgaaggagggattacagttgatatgtagaggaatattgcagtggttattgctgcatttcctatgtgactgggactaaaacagatcagctgatagtgttagcgtgcagtgagcagtctgatgactatgacacagaaataagaatctccagcattctgccctgggacatgtggagccttgggtcagatgctgctggctattgatgccgggaatggagaaatccaccagggcaactcagtaaaaataaataaataaataaataaataaatacataattaaaaaaagggtatccttgtcctgtccaggatgagatgcttgcttccatgcacttacgacaatttttgctgtcattaaaaaattttcacattcacagtcttctaaattcactttggagtgtattggattccactgcattgacatacgtaagtttgcattaaaagatcctttaagatatctggtcaggcacggtggctcacgcctgtaatcccagcactttgggaagtggaggtagaaggattgcttgagcccaggagttcgagaccagcttgggcaacatagtgagacctaatctctactaaaaattaaaaaaaaatccttaggcgatctgttcacagattaatcttgtgattggggcgattccagaagtggtaatgggttgtgctgagctagccccacactctctctgagaagcagtgtacagtagtgtttaagggcaggggctctaaagtcagacttccagagtaatacccccccccccaacctcacaaatcagtttctactatatttatatctgccatcccagtgttggtggtagggtcttcagatccctggggaagcagatggtgggatgagagtaggagagttgtgttgggactccaagtgttgaaggggcacagaaagagctgagtggcacagagaggttgtcccagagtagcggagtctgctttggggagaagagagattgactgaggatagcatcaagtttttcattttatgtacaaagatgatctttttagcttcacccaggaagtatgggttttgtgtcttcctcgtgtttaggtttttattctgacctaattaggtctaagctgaggtgcttatttctcttctggagtttatatcctagaagctctccaatcgaagccctctgcaggtatcctcaggtcctggagaaacacagcaggaaggcttgttggcttcggaaagggagggctatggtttaaagccagtaagatgtgggtttgattcttgactttgtctcctgtaggctgtgtggccttaaataagttacctaatctcttgagtcctcagtttcctcatttgtaaggcagaggaaacaatgcctatgattatgctgattaaatgaaacagaggcacaaaataagtgtttaatgaatgacaactactattgtcattattcttcctatccatgctatctgccatgtattggaggcaaaagctgttactacttcatgcatatgcgctatgcaggcttccagaatgaaactgatggggtccctttcccccacatatgtgagagggggtccctcttatttcaactcgttcctcattgctggtttggcatatctcagctactctaacccggcaagaatccacagaagaagccaagaaggaaaaaggcttatacatttgctttacccataagaaaacctcaagccctgtatctgaaaaaagaggaagataaaaggatctataagacttcaagttccatgagaagagggacatgtctattttgttcaatactctatgcccactgcctggcacataggcagcaaaacaaatatctgtggaatgctatgtaaaggcatctatagatgatgtgcctccctttaagaaacccaatatttgaatatttgcactcattcatacaagatcctcaagtgctccgtttggataatctggagggtatgaaaacatagccaagatcatgaattctttgggcatttgggccgctgcactgttgcaccatttagacctgtgatctgagagtgtgaaaaactcaagggatcctctgtaaagtgtctgcctttttttccctcctgggaggagccgttagaagggcaacattctcctttctcccccttggacgtgtgggtgttggggcaagggtgaggagtgacagaggtctcctgggaagaccataagatggggcaagcacaccacagtgaggagggggagtctggctatgactttagaatttcctgatcgaaatttctcctctaaagctccccaccctacttgggatctgaggttatcatcccctcccagtcccaagaacccttcttcccttgttggcagaaatctccaggaagcatgcccacaggaaccacaactcatgaatcagaagacagataattaaccgagggagtgactgagcagcttcagggatgaaccgcttcgttttacccagccctctctgctgcccacagagtgggctgctccaccccatcgcctctgctccctcttcctgaaccttggcccttcctgagtgggaccttcattgtgcctgatggagctcaggccactagtggaaatgaaggtgggagcagggaaatgactctgtttaggggaactgcctattccccgtgtgggaactgctggcatttattgaaacgtgagactctccagcaaaaaagtgatagcatctgcctttctgtccacacacacagtctcaccaaaaacactctttttttttttttgttagataattcaggtataatttatgtacagtaaaattcaccctttttagtgcatacagttctatgaattttgacaaatgcatatagtcaagtaaccattgccatcatcaagatacagaatttttccatcatcccctaaaattcccccaagctctttttttcccttctttttctttctagaggcagggtctcaccatattgcccaggctggtctcgaacttctgagctcaggcaatctgcccacctcggcctcccaaagtgttgggattacaggcgtgagctactgtgccaggtgcccccccagctcttttgtaatcgataccctaccctcaaccctcgtcggttgcaactgctgatctatttcctgtccctgcagttctatgttttacaaaatgtcatataaatgaaagcatgcagtgtatagactttcagtctggcttctttcacttagcacaatacatttggggttaatctatgatgctgcatctatcagtaactctaagacattgtctgaggccactccgtcatcctccgtgttggaacagttaccctgaaagcagtgggactggatccgttaaactttggaggtgctccccagctttcagcttctaaattttataattggatagatgtatttagctatatataagtcattagattttccatgtgctaagtagttaaagacttcaggatactagagaggattctgtagcaaccaacacttattattcttgctcataggagtaacagatattttgtggccaaatattgtatgtcatgatgcttggagtcagaagttgttaagtaaacctgggggctattctacctttttacatttttggtagcatctctgaaaaaacaacccacttgactttttttttttccttttttttgggagggtgggtgggtgggtggctttttggccaaaaccagaaagcttgctagacaaattctaacactagatctaacactagatgtcttatttctgtttttctgtcatgttcccatgaaaagactatttacttacccccctctctcggttttatagttgagttagttcaatttcttagttcagttagtgaagatgtttaaatattcaaggagagaaagaaaaagaacaaggtgatacacattttaaaaaagtcaaaataacaaatattgttatttcttggctgggcgcggtggctcatgcctgtaatcccagcactttgggaggccgaggcgggcggatcacctgaggtcaggagttcaagaccagcctgaccaacatggagaaaccctgtctctactaaaaatacaaaatcagctgggcatggtggcatgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacatttcccctcgcatttatgtttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttccccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatccactgatggctccagaccccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattcctttttttttttccattctcttttattattattattgtttgaaattgacaaataaaaattatgtatatttatgatgtacaacatgatgtcttgaaatatgtgcgcattgtggaatggttaaatgaagttaaataacatatgcattacctcacatacatacttctgatttatttgtggtgagaacacttaaaaatctcctcccagcaattttcaggtagatgacatacggttattaactatagtcaccatgttgtacagtggatctcttgaacttattcctcttgtctaactgaaaatttatatcccttgaccagcatctcctcatgcaaaccataccccaaagctcatttctgtgttcctgctgagtttgccattccaagaggttttgatgctgaaggtgcagtttgtggaaagcccagcagactctggggagcctacatttaaataaatgcaaatgtcgacagggaggcagaacagaggacatttcaaattagctttaattttcttttagcttataaaagtaattaagcttattatttaaaaaaaggcagctcagaaatataatgcagaaagtaccagtaccagttccttgtagtcttgtccttaaagataaccactgttgatagttactgcagagtttttttctatgtatttgtcaacatatataattatttatcattattgttatttctcaaataggataatcaataataggatcattgtcttttttttttttttttttgagatggagtctcactctgtcgcccaggctggagtgcagttgtgtgatcccagctcactgcaacctccgcctcctgggttcaagcaattctcctgcctcagattcccgagtagctgggatcacaggcatttgccaccacgcccagctaatttttgtgtttttgatagagacagggtttggccatgttggccaggctggttttgaactcctaaccacaggtgatccacccgcctcggcctcccaaagtgctgggattacacgcataagccaccgcacctggcccattgtctcttaataatatactctaggcatctttttatgtcagtttatggctttccattatttatcccaagagctataattctagccataaggcatactctttgttatatggatatatcagaatttacttaaccaattccctgttggcagacattgggatcattcccaattatttgctactacaaataaagctgcaggggatatccttattcatttattatgcacctttgttcaagtgtttctacagacttaatttcttgaatgaaagttggtgggtcgaagggcatgcgtattttaaatttaaattttagtaggtgttgtcaatttgtcctcccaaacggttgaaccagtttgctttcctaccaagacaggctggcagtaaggactggtgttagcaccgcggcctgctgtccacacccataacacatgagctgggggaggaaggctgcagaactggacagcaggatgccaaggaggtcaccaatagggcacccctgggctgagcctcggacagcttggtacagacctgcttcttctgtatactgaatgaggtggggtcgatgctaataaaaatttccagaactcttgagatgcagcgtttgagtcaaatatcaggccatcaggaagaaatggccacttgtgccttgtttgagggttctcatgccttgggttgctaggcttcctagggtatgagtccccctgttgatgttttctggctggaagagtggatacttccaggactggcagcaccttgaagatcatcaaatttgacacctgtttgttttacaaaaaagcaaaaagggagttcctgagaagtgaagtgacttgtccaagatcatacaactggctcagtggcattggttgggtctctccctggggactcttgtctcctgcccagagtgatttcttcactatatcctgttagagacaaagggccctttcacgtctgaccctgaggtggaggcgaggggatggggattcctggtgtaggaagtgactagagtgaaagtaagggggaaggaaatgaacatttattgagcatccactatagagggttctttcatacgtgttatgtcatttaatcctaacaactcgggagcactggggaaaggaagcagctgtttggagtctccggtgcttggccgatgtggctggttagacccgttaaatactacagagcagttatcacttctcgactatgaatgtgacatagactcaaagaggcactgggccttggagagagcaccagagagatgaagggatgtacttgaggtcatacggccagaggaagggcaaagatggctttagacgtgaggtttcctgctgctttgcatgctttttctgccatatccatctgttgttttactgctcctgccttaccacatttctcaggagctgggtgttaattttagaccacaaccttagagaagacaggactctgtccctggaatgggctttatgcagtcttcagcacatggcgacctaattaacctcattggagatgataaccagacataatgtggcttcatttacaaggacaggacctgccctagatcttcccattaacatcatcttgaagtgtcagctccacagagagacctttcctgaccacatgctttaaaggagactccttccctcattgcttgctattccccgccccccccacccccaccctttcttttccctttgaggcagagtctcactccatcacacaggctggagtgcagtggcacgatcttggctcactgcaaactccgcctcccatgttcaagcaattctcctgcctcagcctcccaagtagctgggattacaggtgcgtgccaccatgcccagctaatttttctagttttagtaaagactggatttcgccatgttggccaggctggtcttgaactcctgacctcaggtgatctacccgccttggcctcccacagtgctcagattacagtgttagccaccatgcccggcctatcctgctttattttcttacagcatgaagggtcaatgaaaggatatggccagtggtcaagacatttgaactttgtgtacagggaatccccttgctcagacaaaaatccttcctgtttttcccttgtgaacaaaagttctctgaaaaggaattgggaggaaagactttattccaatgaacagtttggaaactggggaaactcagctgttggtgtcagaattgggggtttataatgaaagttcctgcctaggatcctgatgaggtccacttatgcaaatgaacaattccaacttgcttagttctgtttggttgaaacaactgaggcctgattggtcaaggcagcagagccctgactggttattttaggttagctctggaggtcccaaagttgaagagaggtgttgattttcagggaactcaaagtgggttgtgacctctagtcagcaaatggcagctttgctctgtttaaaatttaggcccacttagccactccagatctatcttgaaggactggctctttcaggttcacatttgttcacaccctcatgccccatgagccatccatcagcaagtctttagatggaacgtatctagagtctgaccacatcagtggctccgctactgtccaaatccactgccatctgttgcctggattattttagtacatttctaattgaataataagtctctttcctttttgcttcccttctttctgtcttgcactcagcagccaggatgatctttttttgctcacctctgctcagattcctccagtggcttcccactatgtggagaaaaaagccacactctctaccatggcctatagcttcctagtgttctggtccctaactgctcctctaacctcctctgtgcttttctcttcctcctttctctccacctgctatttctttaacaggctgatgtccatccagatcttgccttgggttctttctggaatgtctgtgccttggatcgtcccaggattcactctttaacatcattttgaaatgtcagctccacagagagaccttttctgatcacatgctctaaagagagtccttccccttattgcttgttattcctttatcctgctttattttcttacagcatttgccactgtttgaaattgtgcatttttgttgtgtattttttgttaccatcttcctcactaaaatgtaagcttcacaagagcaggggctttgtttagtttatcagtgtgtctccagtgcctaggagagtgcctggcacaggtagatgctcaatgaatatttgtcgagtaaatgaatgaatgaatcaatgaatgctgacaccattgatatatataggtagaaaaatgtacagctaaagtaaccatttttcaaaccttatccatacgtggattaaatgcaacaaaaatttcatttcatgctggctttttttcaatcatgcaaagtatttcacggcagtgttcttcaaaatcatgccatatacatgatggagatgcaaatccattttgtattagtttcttagggctgttgtaacaaagcaccacaaactgggtggcataaaacaacagaaatttattcttgttggaagctagaaatctgaaattaaggtgtcagcaggcccatggtccctctgagactctgggtagaatccttcctccttcctatcttctggtgttggctggcaatccttggtgttccttagtttctggctgtatcactccaatctctgcctcatgtggcattctctctatatgtctctctcttcgtgtggtgttttcctcttctcataaggacatcagtcatgttggattagggcctaccctaacgacatcaattgatcacatctgcaaagacctgatttctctgtaaggtcatggtcatgggcactggggtaaggacttcaacatatcttttttggggacataagtcaacttataacacattttaatattggtggaggcaagttatacacaaatgttttccaatgttaaataccgtacttaactggctctgatatacttaaaaacagttttaaatctctaaaatcaggacatatactatattcatagtgttagatttgatgaaatatggtgcctgggttctctactgctttgggtgatgcttactggagctttttgctcagagcacagaggtatgtgttaccctaaactccacctccctgtctccttctccttccttgggttacttagctgatgctacatttaaggaaggaccaaaattaaaataaactttcttagcaacttgctctagataaaccacttgtgcctatgtaggacagtaagcatgagatttttttttttcatgagtcacatggccaggtgactacaatgaggcatcatgtgagtcacccactgtccccatggacctaattgggaagtgagcagtcaaaggtcagtggcagggctggggacccagattagaactcctttctggcagagtgatagatgtccatagtgttagtggaacatcctcccttctcgataaacacctcttactgtgacttagccctctcctgtagtcccctgtcctcattagggtggcctgttcctacagtccagcatcctgtctcactggacaacatgtcctcaaaatagcccccattgacgcattatgacttccactggatccaattccctcccttgtttcctttgttcttccatttttcccaccctttgtctctcttctgcttctgtgattcaagctgatgtgccaaaccacagccttctacttctactttccaggcaaacttcttggctggtcttgattggattaaaattgttattttcaaaaaacttttttgaggcagggtctcactttgttgcccaggctggagtgcagtggcacaatcacagctcactgcagcctcaacctcccaggtccagctgattttcctgcctcagcctcctgagtagctgggactgctggtgcatgctaccatgcccagctaatttttaaaaaaattttcatagagatgggggtctcactatgttgcccagactagtcgccaactactgggctcaagcaatcctcctgccttggcctccgagaatgctgggattacaggcatgagcctggattttcgaagactaatattcctaaccccatttagaagccagatctgacaagtaaacatttcaccctggtgtgatactttctggctccacgctcccacgactccttctgctcagggcatacttaacgtcatgtctagtgtcccctagaatgatgtcatcaaggaaaaaaaagtattcacctgccctaaacaatttgagactcaggataaaaacaacaataaaaccaatataaattacagcagcagcagcagcagcatttattgagtactttctgtgttccagctgttgtgctcagagttttacagggtttggtttatttcatccttacaaccaccctgtgaagactggggtcaatccaccttgtccctggttctggctaacctgtcagaggaaaggggtggtaggaggtaggagttgtttgttctgtaagtgacattatggtgaagattcccactttagcaggaatgagtctgggccccagagaatgagcaggaacataggctttatgaatgactggaaacagaggcccaaactccttccacacgttcaggagggaggggtgggctcagaacaacaactcattgaatcagcatgggctcagtgcagagacttctgatgagtcagtcacttttaaccactgcattccagggaatctgcctgggtagcaggacttggttgggggtatcatggggggttcattggttctcataaaatcaacctgtgattcattaaaaagagtggataaagggacttggtaaccatgactctgcaggcatgatttcctaaagaacaaatcccagcacctcattttatcctctggggtcagggaccattagttcactgggagggacctgctgttatttattttgtatcttgcaaaactttctattgtggctacaagtcaaggactcatagggaaatgctaatttgagaatgaatgggtggttaaatgaatagactgggaaaagtcctaaaaagtaatctgacagtgtctgtattagttcattttcatgctgcttataaaaacatatccaagatttggtagtttataaaggaaagaggtttaattgactcacagttcaacatggcttgggaggcctcaggaaacttacaatcatggtggaaggggaagcaaacacgtccttcttcacatggtggcaggaaagataagtgccaagcaaaagggagaaaagccccttataaaaccatcagatctcatgagagctcacttactatcatgagaacagcagcatggaggtaactgcccccatgattcaattacctcccatcaggtccctcccacaacacatggggattgtgggaactacaattcaagaggagatttggggggtggggcacactgccaaaccatatcatttcaccccaacccctcccaaatctcatgtcctcacatttcaaaacacaatcatgacttcccaacagttccttcaaatcttaactcattcaaggattaacctgaaagtccaagtccaaagtcttatctgagacaaggcaagtcccttctgcctatgagactgtaaaattgaaagcaaattagttacttcctagatacaacgggagtggaggcattgggtaaatacagccattccaaatgggagaaattggccaaaacaaacaggctactggccccacgcaagtctgaaatccagcaggacagtcaaatcttaaagctccaaaatgatctcctttgactccatgtctcacacctaggtcatattgatgcaagaggtggtctcccatggctttgggcagctccacccttgtggctttgcagggtacagcctctctcccagccactttcatgggctggcattgaatgtctgtggcttttccaggcacatggtgcaggctgtcaatggatctaccattctggggtctggaggatggtggccctctgctcacagctccactaggcagtgcccgagtggggggctctatgtgggggcctcaacccatatttcccttgtgcactcccctagcagaggctctccatgagggccctgccttgtagcaaacttctgcctggacatccaggtgtttccatacatcctctgaaatctaggcagaggttcccaaacgtcagttcttgacttctgtgcacctgtaggctcaacaccacatggaagctgccaaggcttggggcttgtatcctctgaaaccatggcctgagctctatgttggtcacttttagccatggctagagtggctgggatgcaggtcaccaagttcctaggctgcacatagcagggaggccctgggcccagcccaggaaaccattttttcctcttaggcctctgtgcctgtgatgagaggggctaccatgaaggtctctgacatgccctggagacattttccccattttcttggtaattaacattcagctcctcgttacttatttctgcagctggcttgaatttctccacagaaaatgggtttttcttttctatcacatcgtcaggctgcaaattttccacacgtttatgctctgcttcctgctgctgtatgctttgctgcctagaaatttcatctgacagatcccctaaatcatctctctcacattcaatattccacagagctctagggcaggggcaaaatgctgccagtctctttgctaaagcataggaagcatgacctttactccagttcccaataagttcctcatctccttctgagaccacctcagcctggacttcattgtccatatcactgtcagcattttggtcaaagtcattcaacaagtctctaggaagttccaaactttaccacatcttcctgtattctgagccctccaagtttctaggaagctccaaactttcccacattttcctgtcttcttctgagccctccaaactgttgcaatttctgcctgttactcagttccaaagtcacttccacatttttggtatccttatagcagcactccactctaccattgccaatttactgtaatagtctgttctcacactgctaataaagacatacccaataccaggtaatttataaaagaaagaggtttagttgactcacagtttagcatggctgagaaggcctcaggaaacttacaatcatggtggaaggggaagcaaacacatccttcttcacatggtggcaggatggagaagtgctgagcaaagggggaaaagccttttattaaaccatcagatcttgtgagaacttactattaggagaacagcaacatgaggataatcatccctgtgattctattacctcccactgagtccctctcatgacctgtggggattatgggtactacagttcaagatgagttttgggtggagacacagccaaaccatagcagtgctcatatctcccatggtcctcttccctcttctaacccttcttgatgtcttcttgtgcttctgtctcttgtgaatatcaatggcatttatgtccagaattaccccttggcatgccaattcccatggaaactccagaaagggagggagatacttaaaatagttcaggctgtgctcctctcagaagtcttctgataggggaaaaaagagaggctctgtccacatctgcctgggaagagagcaattataaggctaagagatggccaggcagctcatgcagggagaagtcttgggttgcattgttcgttgtgaacattcaggaattctgaaactagcagccacttttctttcattatagacattgcatggctcagggctgccccatctcagaggtgaccttgatgctttaaggccaggcttggaaccaatgtcatcattcccactcatgggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgcttcaaggattccgcatataatctagggtttttgggagaacaatgaaagtttaaattgcctgaggaattgttgtagcccatttacatgttttatattggaattctatgcataattttgagaaatgagctcagttgcttaaaaaagcaaagcaaaacttcatctattcccctacctttcattttgccccagtgcatatttactgagcatctccactgagtaagaactggagctgagctgggcagggcagagcaggtctcaagggacttaaaatctgttgggtggcagtgttgttaaggcagacacataaattattatgatgtggtaggaatattagaattgaagaaatggaggctgagaggagttaaatgattcacccatggccacactattagtgggtgactcgattaggatgacagtctactcattgtgtgtacccattctgttagacctcctgtcccccaagtaaggtcctgaaatgggtactgttaaagtatatataattttaacagagttaaaagtatgatttctacacaaatataaagggaatatgtgtaaaagattttattcaactttagtaattaaagaaccagtaagacgttaggagtagttcaaaaggaatttcaaagaagggagatttatggttgatcagtcaaaggaatgctgaaatgaattagtgaatagattgaaaattggttaatattctgcaaggcaatgaaccttaacctgtgggggataaccttttctaccagacagaaatcattggtattgttgttggataagaataatatacattgttctcttatctaaataatttaccttgcacaccacaatatgatcatgattagattaaaatgttgtcttagccagttctagcagctataacaaaatgccataaactgggtggcttaaacagcaaacacttatttatttatttattttgagacagagtcttgctcttgttgcccaggtggagtgcagtggcatgatatcggctcactgtaacctctgcctcctgggtttaagtgattctcctgcccctcctgagtagcctcccaagtagctgggatcacaggcgcccaccccaatgcccagctaattttttgtatttttaatagagacggggtttcaccatgttggtcaggctggtcttgaactcctgacctcaggtgatctacctgcctcggcctcccaaagtgctgggattacaggcatgagccgcctcaccggggctatttttttttttttttttttgagatggagtcttgctctggctcaggctggagtgcagtgacactatcttggctcaccacaagctccgcctcctgagttcatgccattctcctgcctcagcctcccaagtagctgggaccacaggggcctgccaccacacccggctaattttttgtattttagtagagacagggtttcactgtgttagccaggatagtcttgatctcctgacctcgtgatccgccggtctcggcctcccaaagtgctgggattacaggtgtgagccactgcgcttggccattttttttttaaaagaataatatacattgttctcatcaagaattatttcccttttttttgagacagagtctcgcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttctttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctgaactcaagtgatccgcctgcctcgtcctcccaaagtggggagattacaggcatgagccaccacgcctggccataatttttctttacaatattgtgtgtgtgtatacaccctcattttctgagtgtgtttttgtccaggtgttgggaaggagggaattcagtcacactgtaataaaatgaatggagacagctaaatgagaagttttggggacactgggaaaacatcgcaatggtcaggctgatttctccaaaataggttcgctggtcttaccagctggggtcaaagaggtccctttggaaaactgcatgaaggagctgtcagggtaactgggtcatggagaggaacagatccctcacattctgctccttatattggaaaaaacctccttaaggcactgcaggaagaagggttcacctggctggagcaggaatgctgagctaggcaattagagaggacagtggcttctgtctaagcagatgcctgggtttggcttcctggctgagcttctcaaggtgattttggttctcctggttgtttctgctcctcctcgtagcctttgctctgtcctttgacagtatgaggactgttcacatttgaatagcaccttatagtgtaccaagtgcttccccttacctcactgaattcttgtacaaatcctgagagacagatattgtcatcccatagaggctagttgagttgcccaaggtcatgaagtagttagcaggaagaacattcagaattcaagcacaaaccttccaactctaaaattccatgttcttttagtgtatatcagtcagccttttctaacatttctgcacttcctcctagagcattttgtggttggattccaagatatatgcattgagaagcttgagaagatttcagatttgcttttcttttgccagtcagtgggacactgccaccaaagtcacctcaccctccacgcccccactgtatttaggctatgtgttaatgttagtgcatctgggccttggatcccctgtgtagtggctgtgaatatcactagaatgactgaagaggggatacattgccatttttctgggccccggagatattttcatttgcacaatgtaggtgtcaaaccagttgttaattaaagcctttccatcagttacgatctgagacttgcgtccatggctcagccttgccctgtcacttgttaccactgtggcctcatcagttgagagcggtgatgagtttctcctgattttcctcctcctccttcttcctaaccaataacctgtatttggtagacgtctgtggtatggttagggtgtgtttgtgtgcacctgagagctgtaaacctggacattgggaaagttgggaaggatgaggcaggcaagtaccttcactgagccaaatctggtgctaatgcctttgtctgtctgttgcagggcccaacatctgtaccacgcgaggtgtgagctcctgccagcagtgcctggctgtgagccccatgtgtgcctggtgctctgatgaggtaaggagcagataccagaccttgtttcttctccagactaagctgcttttgtgcagaaacagacccatgaagttatcacctccctcttgaatacacatgccccttatcccttctaagcaaaactttgatgaatttttcccattgatgcatggtgaggagctgtcatggggatgttgctgggaatactaacccaagtctaccatatagcccctggcccttgccagtttggctcgacctcctgtcctctctgtaaccactgctgccctttctcacactttgcttgctttttttcctaagaaaaacagtttattttaaattttttggtagagacagggtctcactatgttgcccaggctggtcttgaactagacataagagatcctcctaccttggcctcccaatgtgctgggatttcatgtgtgacccaccatgcccagccctttgcttgcatttcttggggtggaatatcccagggaagcagggcgtcaggtctcaaaaggagaggcagcaaggggtataggtacggatggggttgggaggggttgctggcttacttctttttcctagaggttaaaaaaggcaaatagaagagaaatcttgtgcttgtgtgtggtgatgtttagtcagaaaatcttttctcttcccttctctttgatgattgggccccgcggctttacatttttctttctcttcttctttccttccttccttctcacaggtgttgaagaaaggagctgggcccacttggtgaggatggaagggggacaggaaagggttagttgtgtctaggcagagggtttgttgtgtctggggccctagggaatgagtgtgtctgagggaatggctatgtttgtggctgggatggaaatttggagctggcaagagctgatggggtgggggtggaagatgaatgtggttgaagagattcggtgattatagagtctcaggctgagtcactggcctggccagcaggtggttacctgagttcctggcctggctgcggctcagctacctgaggcttcctctgtcccacaacaagtcccagccctctccagttttatgaccgctccaatccagccctcagtctctctgtctgcttctttttcagatctgctgagtttcctaaaaaggcaacctccctggccgcctggggggaggggcgggagctgggaggctgtgtttatcaccggccaggagggctgccagagcagcagaggccagctccgcacgttgctttggcctctttgccgttcagcacgggaactgcttccagaggcagctgcccaacatctgggccacattaacttcatttagcaaatgaaacattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagagagagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggtcacataaccagatttcaaagatgcaaatgtagaatatttatgggtgactgttgtgctccttgtcccctggggcaggcctggggagggcagagggaaaggtgcagggtagatcagagcatgacataggaccagcctaggaattaggggtgcagtcagtgaggaaatgggcgcagctaggaccaaagaaaacaaatggaaggaggtagaaagtccagtaagatattccctgggagaatggcatataaacatgaaaggaggcggggccaaggttagtgaaggactacaactatccctcagcaagagggaggagggagagaaggaagggtggaggaccccagtatgggacagaatgtggtgaccggggagggatgggaggtgggaatcctggactgtaacctgaacataaatgctattttgttcttgagaggagcagggcttcccctggataggccaagtttaactgctgaaaatgccttggacattgacttcaaaaaaccaaaggtgaactggctggtccattttttaggtaattttttgaataatcaaaccttggagagccctctgttcttcttcctcccctgagttggctgttccaggcaagctggcagtgcctggaaaaacaactggttgggctcggctttccccttggtcctagaggaccggagctcttgggtgtgtatagtgagagcttggctgggtaagaggaaaacagccaacgtggatgagcacggagttttgggcccatctgcatagggtgtgttcttggagggttggataccgacgcgggttgggttgctgtgctctctctggtccataaatctagcaaagaggcgggctttatacagagactcaacgcgtagtcttagtctcaacagtgacatgctggagtctagaacctcccaaactcatttggtgttgagaattgcctgaggtgcttgttaaaaataaagcttcccgggatggatcctgggtctgttacatcagaatggatatttatgatagcaagtttggcaaacattgctaattgaagggccactggggttgggtcaaggtggatggaggtggagttaaggttgccagataaatacagaacatccagcctggtgcctgtagtcccagctactcaggaggctggagtgggagaatcctctgagcccaggagtttgaggcaatagtgcaccatgatcatgtctgctaatagccactgcactccagcctgggtaacacagggagatcctgtctctaaaaaataaatctagattacagaacatccacttaaatttgaattaaaaaataatttttagtataagtttgtcccaaatatttgctaaatttggcaaccctacagtggagggaaatactaggaattcttatataagcctgagtacaccctggaaggtgggccagcttcccacttagcctgacaaccaagggtgacagaggaagaaggagtttgagtctagcaaagtagaggaagactctaataggatttccttctcattttcttctctgcaactgcaggagcaagatataggccatgatttacatttctttataatcacaaacataattttattctgacttgtcttctttctatttatttttaatctggaggacaaatgttcatcttgagagttttgctccaatttattattgtaaaaggaagtataatattaagagtgctcctcttcttgtaaacaatgaaatgtgaataccaacaactataaacaaaaatgcttcatgttcctcccctcctcctttctgccctcttcattcttttctctttgcatgttcaagtgatttcttgtcctcaccagatgagttaatcaagacagcaatggatgggagatgttttggtggtgctctggggtaaaaaaagtactggggcatattgactctcgctctccaagaagagtatgaaataatagtagttattgtggtaactgtaaaaaagagtcacctgccaggtgtggtggctcactcctgtaatcccagcagggccaaagtgggcagatcacttgaggtcaggagtttgaaaccagcctgaccaacatggcaaaaccccgtctctactaaaaatacaaaattagctgggcgtggtggcgcaggcctgtaaccccagctactagggaggctgaggcaggagaattgcttgaatccgggaggtggaggttgcagtgagccaagatcgtgccattgcactactctagcctgggcaacaagagcgaaactccatctaaaaaaaaaaaaagagtcacttatatttgcatttatttgcttatactgtgtcctaaagcaggggctccaattcctagtccatggcctgttaggaactgggccgcacagcaggaggtcagcagcaggtgagtgagcattaccgcctgagctccaccttctgtcagatccgtggtggcattagattctcacaggagctcaaaccctactgtgaactgggcatgggagggatccaggttgttcactccttatgaggatcaaactaatgcctgatgatctggggtggaacagtttcattctgaaaccatccccacctccctgtccatggaaaaattgtcttccctgaaaccagtccctggtgcctaaaaggttgggaacctctgtcctaatggatttcagtatagttaacttatgttgagatttttatattttgaaagcatttcacattcacagtcttcttttacttcctgaccaaccctgtgaaataggcaggataatgacaactattcatgttgtactttcccaatttccaaaatgggattaatggagaatggtaccaagagcgtgtgtcaccctcccaggagagggaggtaattcagccagctcgcagggcgctggctggaacctcccacctctgtgctcaggcccttcccctgggtcttggctatttttgccctttttgtgtaacatccggtttccctgggaactgaaactttaatatccacccctcccccttctagctttcttcctgcataacctggagacattctttctaccttctcagcctgggttaccaagaaagggaatgttgcccaagtatgttgaggtcactgccttggtgctcttctggaacagagggctctcgtggagagcttggctgacgagcaggcctgttatattcctgacctctgatgtcagcaaccacaaagggagggagggaggcagttttgtttttcagtgtttaatttttctaaggaaactcataacaaaccattaggactgtcagcacatcttagcgcttcaaaccctcttctcattaggactgccacattagaaaataggagtcaggaaactcccgtctaatgcattctctccctctgctgatggagcctgaagatgcatgaaggccttgctgctctcatccagtttgctgggctccggtccctgctgtcttcttcagcatctgtcttggtcctggaaaggatccgctcctcactgcattctgatttatccactgcctttttgggaaggttttctccctggggctttgtgggcagctagaatcagagataggattggggcttttttgagcaagagaaagactgcttccagaggaggaaggggtaggagaggtgggcagggacaacaggaggagtctgggcacaaaacctgaagtgcccaagttctccccaggtcattccgtcctcagccagagctgggtgcacgggagactttcatcttcctcagagttgtggaaggtctgtgatgtccctgttggagtatttgccaccaggaaggttaagtcttattcattgatttccatcgccgaggctggttccctgcctgcatacctgtgaagatgagagagaaagagagaagctgctggcttccagaaactctacttacttcttgcctgggccagggtagtcctcatgctgttgatgttgctcgtgtccccatccacgtggggaaggcttcagcccatgaaagggggatcggactggagagggagagagactttaagcattgggaagggttttgggttacagggtttttttgtttttgtttttgttttgaggtggggtctcactctgtcacccagactggggtgcagtggtgtgatcttggctcactgcaacctccgcctccctggctcaagtgatcctcccacttcagcctcctgagtagctgagattccaggtgtgcactaccatgcccagataatttttgtatttttagtggagacggggttttgccctgtggcccagggtggtccggaactcctgagctcaagttatccacccgtgtcggcctcccacagtgctgggattacaggcatgagtcatcgcacccggccggttacagggcttttgagtatgaatggctccttgtggcccagtccctcttctggcattatggctgccaggttgcttgagggggctgaggaggcagatgtcatccatccttctccatccctcgcacatgcccaccttgcatcctgttccctacctggggcattctctgttgtggctcctccctaggaccattccttccacacttttccttttccgtgccttgactctcactctatacggaatgtagtaaagcttattttatgatgataattacagtcagacaatctagctggcctctcagttctgccacttcctagctctgcaactttgagcaaattccttaatttatccaagcctcagattccttacctgtaagattgggttccttatttgtgaagcctccaaaccttaggtttctcccttgtaaaattataatagttccagcattatggaactgtcaggcatattgcaataatccatgtaaagtgctcaccacagtgcctgacatacagtaagtgttcaataaatgtcaacactagttgttctgggatattggtgtgggttatccagcagacatttggaagtgctggttggggatgtgggtaggggtggggttgaggagagcccgaaggcctagacattgtgaaataggtcccgggaggggttttccagcttcctggctggtcccctcaacttggtaaggagccctcatagacatgcacccacacagtgttggctaaattggctgaatgtcagagccggaagggactgaaaacactgtgtcatctaaaggccttgttgaacaggtgaggacacaaaatgacgtatctgaggtcacatgactagtcagtggcaggcctaggattgatcttctttcctgattttcagtgttctttccagggtggcgtggtccccttcaatactcaggtttaagcacccagagccccagggggccgtgggtttttggaagggtactcaatttgttctttgttcagggtgaaggaggacactgaagtgataggatgggctctggttaggtgcctggcccatgttcccaagtttgtggagtttattcataattagcttatccaggaagtacttgtcaagcatctcatagtaatagcttacatttgctgaggacttcctctgtgccaggtgctgtccaatgcattttatgtggattgtcttatttagcctgtgtgacatccctgtgagggaggtaccataattactattattttaagtaacttttattgtgggaaaatatacataacatagaatttaccatcttaaccattttgttttgttttgtgagatcaagtcttgctctgtcacccaggctggagtggagtggcacgatcttggcttgctgcaacctccacctcccaggtttaagcgattctcctgcctccgtctcccaagtagctgggactacaggtgcacgccaccacacctggctaatttttgtattttcagtagagacggggtttcactaggttggccaggctggtatcgaactcctgacctcaggtgatctgcccacctcagcctcccaaagtgctaggattacaggcataagcaactgtgcctggcccatcttaaccatttttaagcatacagttcagtggcatgaagtacattcataatgtcatgaaacccctcaccaccatctatctccttaactcttttcatcttgtaaaactaaaactctgtacccatcaaaacagtaattctctattcctcccagtccctggaaactactattctactttttgactctatgattttgattgctgttaagtactgaaggagggactgttattatgttcgtgttacagctgaggaaactaggcttggaggaattaggtgacttgccttagtaagcagttgtaagtgcaatgctgagatttactcctgtgctcttagccctgactctctcctgcctccttacactgcctttccctatcacatttgtggtaagtcctaggtcggatgctgggaaatgagaggggccaagacacacacagtccctgactacatggatctcacagtctagcccgtgtcaaatacagtagcttccaaactgttttgactctgacctacagaaagaaacacactgtactgggtatagttatttattatatgtgttattctccactctcctccaacaatataagaatttcacaaaacaaccctttgactatttgtacactttcatattttctattctattctattgtattttatttaacaaaatgatggttgacacctgctaaattgattttgggacccacaaatgtgtggtattccacagttaaaaaatgctggtctaccaggcatcttactgtacaggctctccttctagctacaactccatgaataggccttcttgatatctcaatttctcttttctttttcctttttttttttttggtagagacggggtctagctatgttgcctaggctggtcttgaactcttggcctcaagcagtcctcatgccttggcctcccaaagtatcaatttcccctttctgtacaacggtcctaagggattatcccaggaaagaccacaacaatttgtttatgctccaatgtacggggtaaactcttagctattgggaagtggtagggcctgcaggaggtagagagtcgccatagctctgattgctggacttctctttgggctcctgtcttacaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccaggtagggctgggactctttgcggggagagacctgaagcaggtgggcatagagcacaaggtggaggtctgaggaggaagtcttggggaagtagctcagaatggaaatggggtgggaagacaaggatgaggggggaggtgtgggcaagagaatggaagaaaataagagacgttaggacttgagtcagaagatctgaggtgaatctttactgtatcatatattagctatttgaccttggacaagttacttaacccttcagacatagtaggtgctcaaaaaatatttgtttcttctttacccaagtgcctgttttacctagcttagagctttgtgttgaggtgcaaatgagatatagaacaagaaagcgacttgtaagcccccctttcatggggaattgggacaggggaatgggggcagacacaataggtacacaagacctttagagggaggaagggttagactaaagacagaaattttgaagcattgattttgactttccaactaagtcaagaaggatttacctactatcaaggcatgtgttggatgcaatgggattcagagaagggtagggtgcagtttctgtcttttacagagtctgaagtgtagtaactatcaaaatctctgtgactcacagtgatagacccgtggaactcacaggattagaaatcccctgggatttagagaaagtggaaaattttagaatggaaaagaagaggttaaaaataggagggtcaagagattagaagagtaatagaattgcaaaggaagaggaaaagggaccagggctttctggtttgctttgatcatgcaatttcttagtcccaactgtatccaaatctgcttattcaatcttggtgggagaagaagataaaaactaacatctttctgccttccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgagtaagtccctcctccagacgccaggacagcatcctttgccccaggaaggtccaagtcctggttcctatttctagctctaggatcactttgttggctgtcttcttgccaaactatagctcctttctaccttggtctccctgtttggcaaatgggctagcttgtggatctggagtgttgtgtcaatggagcctaaggctgtttggagaacctagaaagaaaattcatcagcttctcagtcttggtaacaaataaatagaaggcaagagagaatgggagggaaatgacgtcaaaagtagaaagaaatttatggataaggaaaccgagaaattacgattacagaaggatcgattccattgttggcattattgtcttcatcaaggccgtgcatcctgcagggtgaaaacagaagaaatgaagtgctaaggaatataaaagagtggaaatgacatttgttggacacttttatagtctgtaaatggataacttgtgcctctgtttgacactttggcttaaaactgaatggcttatttatttaatcggtggagactgtgcaaatccatgtattagaataacttacaatgctggttgctgagcctgaaaaggtgtgaatttactttttagttttcaaagttacggccaggtggggtgactcacttctgtaatcccagcactttgggaggccaagatgggaggatcacttgagcctaggagtttgagttcagcctaggcaacatagtgagacccccatctctacaaaaattacaaaaaaattagctatgtgtgatggcgcatgcctgcagtccccaggactacagggaggctgaggtgggaggattgattgagcctgggaggttgaggctgcagtgagccatgattgtgccactgcactccaacctggacaatggagcacaactgtctctaaaaaaaaaagaaaaagttttgaagttatatgatgtggcattcaaccttctatctgggttgtaaggttcccaggcaagacatcagctattaattaaacacactattttgactgggggcagaaatgctcctgtcttgcatgatctatcaatttattgatggttcagggaccttaacttactgatggacttttgctttattgttactttaggaaagtgttaagtataaggtgatagtaatagcaactcgagcctcgctctggtctaagtgctttgtgtgtatgaacttacttaagtctcacaactcttatgggatatgtgctatcctggcccctctttcataggttggattgagaggcttgccaaaggtcccatgactagtacagagggcacctgggatctaagctcagggagtcttgtttccagctcaatctcttatcttctaggttagctggatgggggtaatgttgatggggagcttcagataatttgaggattttggagtctgaactgtctgggtaactgtggttgtatggaactggccttggcataccactatctatatttgtcccctctctttcctcccaattcccatgctgccttttccatgaaggtgtctgcttaaattatctcccatccctccccagtatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgtgagtttggaggacttggagtgccaggtgtggctggcatagatcaaaatgggaaaggaagtgactgaactctggggatttctggtgtaaaatgagatgagaactaagcagggcttcctgcagttatgagtagtaagttgctcctgatattcagccttggcttagatccactccctggcctgagctgacatttctttgaacctcagtggtctcagatgttcccaggggagagcatcttcccatcttcagagttacttcagagttaaggctgagttaacttaacctcagcaaagtaggcagatgttcagatgagatttcttctagcccagatcagctctgtggatgcacgtcagtttctagatgagcaatgtgactgtcattagaagagttaagtttggagtttaagaagatctcattcagctgcttgaactaatcagctatgagactgttttctgaagagaatgaaactcctgaactggaaagcttcagcttcggttccaaggactgggactgagacccttgttttgaagaaaaataagctgtccagccctttagccagggagcaccttgggtctctgttctctaccagtgacatggctgaatttgttttgtctcctctgcctttgttttttgttttcttttaacaggaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggtgagatctctggcaccacctatggtttctattcatgattgtgagggttgccctaatctaggcagagtctgtgtgaatatgaaaatggcagcccctccttctgggcagggtgcagggctcggttccagcttgcccctatcccttaccaactggacaccgtcatccagcatacaacctatataaccattagagatgtccctgattgtggtgttatcactgccttcactgtcaccagcatagcagcagcatcatgggatccagaatggacccaaaggatttttacaacccagctggaaagcaggtcttcctctccactctgattagccctttcttggaataccatactaacttgtggttattggaagaagacagaggaaaaaaaagagaaagattggccaggcatatgatggctcatgcctgtaatctcagcactttgggaggctgaggtgggaggatcacgtgagtccaggagtttgaaaccagcttgggaaatatagtgagaccctgcctctacaagaaaatgcaaaaattcgttgagtgttgtggtttgtgcctatggtcccagctacttgtggggctgaggcagaaagatctcttgagcccagtagtctgaggctgcagtgagctgtgatcttgccactacactccagcctgagtgacagagcaagaaccacccctgcttttttttttttttttttttttttttttttttgatacagagtcttgctttgttgcccagctggagtgcagtagtgcaatcttggctcacaagcttcaccacctcagtctcctgaatagctgggaccacaggcatgcactaccatgcccagctaatttttgaaaacagggtctttctatgttgcccaggctggtctcaaactccttggcttaagcaatctgccctcttaagcctcccaaagtgctgggattacaggtgtgagccattgctcctagtggagaccccttctcttagaaagagagagagagagagagagagagagagagagagaaagaggggaaagaacataaaaggcatggtgaacaggtcctacgaggaaagattaaagggccagagtcatttagcttgaaagaaagaaggctaaaggatgatttagcttatacatgagaaaacttcttataagttgttttatatggccatagaaggttaaacaagaggaaaatatttaaattgaatcaggagaaattactataagccataagagaaatgtgctgtaatgctctaggtatctggggcaggtgtgaactcttcgtctcctaaggacaatatagcaacttcctcatctaggtgacttaaaggtgtacctgtgtaaaggcaggagactgagctgaggatctaatgagctccctgcaaggtctaggatcccatggacatgttcacgattcaccaccgcccccgcacagtgtccttgagttccttggtgtcagccatatccaagtcaagcactaccagacaatgagtcagcaacatttgacccctaatctatgcaaggcactgggccaggggctgagggaggtaacaagactatgtatggttctatccttggggagtttttggtctacttgaggagaaaggatatatatatttacaataacacaagatgcatgattagtgccaaatgggtgtggcacagccaatgtggctatacgtatccaagggaggaaaggtcatcatgagctgggatggccaaggaagtctcctgaagaaggtgggggctaagctaggccctaagaaaggaggaggattaccaacaagaaggccactccaggtgggagacagtgggccagatcactgctgagtggaagagggagagaggtgagcaatatttggaaagaaagactgagaccacacggtggaggatcacgagggccaggccaaggcatttgtcagtagttccaaaacagaggcctaacccagtcccttgtgcacggaagcagctccatagtattagtgcattaaattcaagcaggaagaaagaggtgcttagttttgacaccactggcctgtacctcttcgtctatccctggagttcacaagtagacttctgtgctacttacccttcttatctcactgtcaccccccttttttttttagagacagagtcttgctctgctgcccaggctggagtgcagtggtgcaatcatagctcactgtaacctccaactcctgggctgaagtgatcctgcctcagcctccccagtagctaggactataggcacttaccaccacatctggcaaataaaaaaaatttttttgtagagatggggtcttgctatgttgcccaggctcttgtctcactttcagcatgaagtgaaatggtttaagcaccaccacactctgagccacagcccaagcaagataagttctaagctttagaccctagagatgtacatgagacgtcattaacctctacatccttcattttcctaggattatccctctttggggctgatgactgagaagctatcccagaaaaacatcaatttgatctttgcagtgactgaaaatgtagtcaatctctatcaggtgactgtgccttcgggcttcctggagtgggccctgtgatggtgggtgccccaggtagccagcctgtgctagcattggatacagtccccaatcaggaaagagtctcccctaatccactccccaggagctaaagattgcactctgggcctttttcctgcaatcttgaacttactaggtatgtgttggtgtttgtggtggtggaggggaggtggtgaggggtgtgagaggtttcctctacttttgctcagggctgaaaaactgctagatatattcctggcagtgacaattgaaatatcccgtaccttcctccaatcttcatctcaggactctcagtgggatttggggagggcttttggagaccaccagcttcctttggtaagctctggacatctttgttttcctttctagaactatagtgagctcatcccagggaccacagttggggttctgtccatggattccagcaatgtcctccagctcattgttgatgcttatggggtaagtgtcttgtgctgggaatagtcccgcggagagtccacctcatttggcttacacagcagggctcagatttgtgagtcccagttgccagtctaccacacggtcttactgccttctccgtgtgctcccagagcccaggcaatggcccgctctagaagggatgcagccttctgagaaggaaggaaggaaggaaggaagagagaaagaaggaaagaagatggggatggggatggtgattagatggagaaggagcagagccctggaattgtgggggcagagtgagggaaaactgggctccaataacagggaaaagagagagctgagacatggggaaggtgaggttgatgaaacattaggtagaaaatgccactttccaaggtgaccagtattggcactccccttttgcaacatctgtgaggcctgcaggagggtgtagctggtacattttacccagactcacctagacgcaagtggagatggaaagagggagcaggttcctgcgcaggaaacagagtcctaggggtgctccggcagcttccaggtcaaaccttggcctctggcactgctggggtgagtccagagctacttgccagatttggcttgggatggaactggctcttgccatttcccgtttcctttcagttcaatttcttgtcttcttgtgcccctttctgctcagaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtaattaatacctttcttttgtaaaacgacacaagaaagtaaaatctaaaatgtaaaacactccagtctctccacgactttccttattggtcgtttctcctccgcttctgcctaaggggagaggggttggtgggaggggaggaaggaggggaagaaaatagatctttggatacgctgatcctttctattgacctatctgtctctcaggcacttgtgcaaacatcccatgttagaaatattgtcctgaaacatgctttattgcataagctatgaaatgtgtgggaactgaagtagatcctgagcttatgattgaccaccatgtgggattgtgtggtgcaaaatagtgctttgtgcatcttgctgataattataatcaggccaaagcagggtgtttatatgatcacaggttctgttcagtttgagctggtctatttcatatgtggagtgaaaaaacagccttttattatttattgactgtaaaccatgtctctgcatccagctagatatgtcacaacgatactattcccgtgcttgtgtttttgctttgcagaccttcatatagggaaggctgaggaactccagattgcaaaagcataagacacccaatttgggtattccttggcagggcagggaacaactttttttttcctccagagctggagtgttaactgggcccaactgtgtctaaatacaatctttctttccatccaggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggtgaggagaactgcagggccccctgtcctggaacccacaccccctcatatacctgcaaccactggaaacataggtgaaggcctgagatgggtctttgcaggcagaggtgtaagtcagtggttcctaatctttttgagtataaggaccaatccccttttcacgttaaaaaaaaaagttactgatagatggcaattaaatttttagcatttatagacttagaaaacacatgtcagaatatgtagtaaggttagtaataattttacatgagtttatctttgtatcacaagagaccgggaaaagagtagtatatatgcaagacattggagtgtgcttgaacaatgtctggaaaatggtgtaatgctcttgttaatgttagcactattttgttaatcactgttactactattggtgctactgttattttttggattctagatctttgctatccaatatggtaggctttagccacatgtggctatttaaattaaccaaaattgaaaaattaaaaattcagttcttcagctcatcagtggccacatgtagctagtggctgctatattggacagatctagaacatttcaacgtgatagaaagttctcttggatagcactgccacagagagtccctgctgacagattggggattataattttaagtccttctactcagcagggtactgagttgtccttctcattgcaaaattcagtaaaatcttgaggcccactgataatctcaaactagtttctccttgccccaagaaccactcctggggtactttcccagctagaagttgaactaatgttaatgtagtctttatccgcagacatgttggcaacactctcagagggcaaatagtcttgagttgttcctggggcactgaggatgggtttttactgggccataatcactgtggcttaatccctcttgcgacagacacaagttggttgggactgggttacgggtgtattgtgtggccaaacagagagattataattgttttctggggatgacccttgactcagattggcttcattggcattggggttcttttttttttttgagacggagtcttgctctatcgccaggctggagtgcagtggtgcgatattggctcactgcaacctctgcctcccagttcaagcaattctcctgcctcagcctcccgagtagttgggactataggcatgcgccacgatgcccagctaattttggtatttttagtagagatggagtttcaccacattggccaggatggtctcgatctcttgacctcgtgatcctcccacctcggcctcccaaagtgctgggattacaggcatgagccactgcgcccagccagcattggggctctaatcagttgagctaatccatgcagatactcacttcgatactgatattaacctttaaaaaagctcacttagaaaggtcgatctgtgtctttctaaagcatgtcagtaacataaaaatgactgctttttttattatctacgacattgtttcctttactcatgctgtcaaaattttagagagagtttggaaggaagtgttatcagaatgattaggggagagcaagagatcagatacacacagatgaaagcacaaacagcaaccatttgaattagggggtgaggcaggagtttcacttcattttactatttaaagtatttatatctaattcaaagtaccaaaggaaatgggtaaatttgaagtgggagacccctgggaagaaggttggggactgagggagagagggtggtcccaggagaggagtacggctggaccacgggggcacccccagtcctcctccatggcctgatggttcctggtctggtgtgaggcactgcggcaggatcccagccagagcatgtttcttttggctgctgccccactaaagccacaaaacaaagctgactgggtcagaagccccagttcctgcctctcaccagtgcaagaacagctcctcctcagtgcattccagtctaatccatgagggaaccagggcagccattgccgcctccctctaccatgtcttgctagggtgtcaggtgcccacccagcctcaggtctagaccctgtggtgccatcatcacatcctccagtgacagatactcaggggcgcacatcattgagcacttgctctgtgccatcatttggtccatatgagtgaacaaggggtcatgcatgatccctgacctctccaagcttaaagccccactcaccattgccccttgccagagctgctggctctatgcttcattctttgctataagcaggggctcaggaggcaggtgttctgtgactcggccatttccctagcccatggcctgtaagcatggcggctggttccctggccatccccgttgtcccctccctactttgggcctggtcttcatggttgctcatgatcaacattcctgcctcaaacatcaagaagtgcatcatcctcaagggagttttccacttgccacagccacagatcagtcaggcagcttctgtgagccagattctgtgctgttgtggagtaggatagagaggcgtgaataagacagttaaccaaggataattcccaacatgaggttgaatctgacagatccaggaagtgtggagtgctcagggaatgttataggagtccactggagcgagacttgactggggacagggtaggcctgggtggcttcatggaggaggtgggatgtctgacagatctcagaggaggggcaggctcaggacagacaggagtggagcgagcatcagcccagaaggtctagctgtggggctcgtgttcccaatgaccttaagcacccgttcctccctcccttttctggctcccctccctttctcctcttccactcttcatttcttactttactcctctgactttccgatgaacccggactcagcctcccttttgctggaagggtgccagtcctgtgacattaccacactgtggctaccttttaagggctaaccctaccaaggcttggggtcagcctgctggctctgacctgtcacttccactcccaacctcactccctggctggcccatcttgtcaaagatcactttgtttagcctcacaaaggaaacactatgggacaagagtttctgaggaggcggaggcctctgagtgctgccaggcccctgtggtgtcggtctttcccatccaggagccgtggccaaatgcagggtgtagtgaaaggccggggggcgggtgggggggcagctctgctggctggcgcactcctcccccagctgctgtgaggttggccgatagcagctcacagctgccccttctgtgaagaactgccctcggctgacaggagctgtcttgcccctagatgttggccaatgactgatggagaaggggttactcaaggctagactcttcgcctcagggtgggcctggctttgtggtgccattcacgtaggatcaggctggagggcatctggctgagaccacattcctgccagctctgcctcttgccatgtcctgtttccctccctcctctctacatcctcagcgagtcccttaaataagatcctcatccaagctgtacttctagggaacctagcctcgggacacagcctttctgctttccccacccttctggcagcccaacatctctactttccagatatacttggcagctggggcagcttgggttatgtccgccatccttcctgggaagcagacatttctttccatgcccagcccatagtgcagtggcatgatcatggctcactgcagccttgaactcctgggctcaagtgatccttctgccttagtctccgaagtagctaggactacaggctcttgccatcatgcccggataattttttaaaaatttgtagagacgggatctcgctatgttgcccaggctagtcttgaactcctgggctcaagtgatcaatctgcctcggcctcccagagtgttgaggttacaggcatgagccaccatgcttggcctttgaaggtttttaagcaggtgagttacatgatcaagttgactcatactttaaaacggtggttctcaactgggaggaaggagctattttgtctcccagggcacatttggcaatgtctggtgatatttttgattgttataactggaaaggtgctactgatgtctagagggtggagctcaaggatgctgctaaacatcctaatgtacaggacagtcctccccaacaaaaaattatctggccccaaatattgaaaagtaccaaggttgagaaatcacattttacaaagagaatcctggccacagaggaattgacaatcacctggagaaggggagatgacttacttatctagagacaggaccaggctgaggacagggcatggaaatatctacagtgaggcccatccacccttcgcttaaatagttcagaacatttgactcctaaaatgttccttccttgaaatttctcattgagatcaagcctagttactggactttccataacttctttcttactactttggtctcttttcttcctccactggtcaatttgaagaatattccattaaaactggctccatcttctgttggttaaggccattttctctgtaagttagagacatcttctggaaagaccatattagtataaatagggaaaagcattgcttatgacactgcatagaggctaagcacttgggatctgaagtcacagtgacttcagtttgagtcctgaccctgccatttacaaggcatatggccttgggaaagttacttaacctctctgacctcaaagggttgttataacaaatgaaaaggataacatactaaagaacttgcggctgggcatggtggaccagctggccgggcctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcaccactgcactccagcctgggtgacagtgagactctcaaaaaaaaaagaaagaacttggcacaagcccacaagcctaggcaatataacaagactcccatctgtacaaaaacaaaaataattagccagctgcagtggcacatgcctgtagtcccagctactcaggaggctaaggtgggaagatcacttgagcccaggagtttgaagttacagtgagcaatgattgcaccactgcactgtagcctgggtgatagggtgagactctgtctcaaaaaaaaaaaaaaaagcaaataaataaaaagaaaaagaacttggcacagtacttgacacatattaaatgcctccttggttggtttggaaagtagatacacattctcttctctaaatgctttccaagtctgttccactgcactcccagatatgatatgatgaggtcagattgagaagggaaccaggtcaagaaagacaggttgtgttggtgaacttgaactgcgcctgtaactttaaataattaattaattaaaaaaatgttgaattgtggcaaacatttctccacctgttgagtgcagaggcaggaaccaggatgagtcaacaggggcatgggggaggccatcgggctacgtgaggtcattactagtgattgtctctactgctgttcaccttaggaaaatctctctttttttcatttaatttctcttattttctgacttcttttctctatggcattcatgggatttgtttaactgcactggccctcggcagtctgggaggtaggggatatttgttctctctgcttacttggctccgttggccaactccatgggttctcagtgccgtccctctgccccttggatgccccaccccatctacccatacattcagggtgctctgtgtgcactttccctctctgcatttggaataaccccatgccctggatctctcctttccttctttccctatgctacaattttcctgtcttgtgcatgtgccctcagagccctgcttctcatcctgcaaggtaacacctagctgatttgagaaatggaagtggtggctgctttgttagtgggacgggaccagctcttccaaactggaccctatgttgttgtctaacccaactgggtggccacgatgacgacaatggtagtaggcctctcaggtcaggtaggagaggcgagcagcgctgtgtcaggtcaaagggagagagttttggggcctgtgaggccttttgccatcatcaagtcacaccgtcaaggctactgagtgccctgtgtaggttcagggctgtggctttgtgctgtgtcagccaaactagaagggctaaagagcttgcttctagttcttagactagaaggaactaagtcttctaagcctcctaccctttctcttgcctttctcagaaggcagaggtattcagaaaagggcaagagagagggcaagaggcccaggagacttagttcctgagaatcttttgctctacagtggctccgagcaagtcctgccataccttgggacccctagaaaactgagtttgtccctgctgggtaggactcccctgggtggtgagccaattccctgccaacctggaggatcattatctgtgtggttgggagagcaggatggtcgtgtgtagcctgctgccatgggagtggagctctcgccagcgggtccaccttcctgggctgtgtgttttcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaagtgagtgtggagtctggagagagccgggaggctgggaggtaggagaggatcccctgactagaatccccagctctccaggtgtgtttcttgctcaccagagccttagggagaggagtccactccagccagatggctgtctctccttttgccaaaggctttgggcaagttggaatagagccaactgtgaaggagccaaagttgaacgagctggacttcgattgagaatgtcctctcctagggtgacatcctgactccctctgagctgggaggaaggctaaaccagtctgaggaacaatccagtgctaatgttctgattcagtgggagatgtgagggctggaattatggaggacactctgtgaaactactacaaacctcccactttaggggccagaggaagccccatcagcctgagtccatggcactgccattctgcttaccactttaagcagggccagatttacgagtgtgcaacctatgcagctgtatagggccctgtgcctacaagggcctcatgcttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgcgtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacctatccaactcccacctgtaaaatggaagcgtgacttctacctcagggaatgttgtgcaggcttgaggaacaatggacacttgatgtgagctggtgtctctgagagttgtcctcctctcttactagtgtgtgcagccatccaccacttctgcttcccagagcccacagactcagcaagagcctgcaaagcaaagggagcaagtgcctccctaaggaagggaagagaatgtatcccattttacagatgaaaaaactgaggcacagagctgggaagtggttgcctgtgatagtcatcatcttagctcagtaggctagtaagcgtttaccaagtttacttaactaaaagtgttatgcagtgcccaagattttgcttaaagctttgcagtttggagggaaaccttcaaccttatggataggcaaccaaaagctttatctgaagtccttctgcctctctggggccccttttgaaataagacagacagaaatacaaacaatagggagaaaaaaaatcttgcctgcaattattcttgaagtattctctgtccttcatcttaacttaaaaggagatgatctttgctgctgtcatcacatctgatatagttatgtgggccagcgaggcattgagatggtactctagtactagagagatggcaatctctccatagatagcaatctcccatgaaggcagaaacacatttcagagagagccacagtaagacacagccagccagtcagcttcctggtgggcgtgttatagaaaagagtcagctctctgggccttttggctaatatcagaagtagggctggggtgaggttagcgatttggggattgagtttgaagaaacagtttttcctctggaggagattaggcttgctatgattagttcagagaggagaggctgctgagatattatttttaccatctacactaggtgggtattacaggctaattgataagcagttctgtacctccacctcccctctacctgtggtattatagtacagggaaaagagtgtggaaataagcatattaaaataaatgcttatttatagggaattttatagcttgtaaaagttataaagtatctttcatatacattatcttatttttctgtcaatagcctagtgaagtagaactacagtactattctcatcttcattttgagtctcaggaaagttaagtaactggcccaagcaagggaatggcaaattaagataagaactaggtcctgaaatccgtactcttttccctgtattataataccactggttttctgaagggttgttgagttcaagtctgcaagatgtgctttgagactcctgttcttgttctgcttcatcactcatttgctgtgtgacctgggtacatttgcttaatttcatcatgtgtcagttttactcatctggtttcatcagtatggggcacagtgcagctagtggagggtaacccctagtatctttgcagaataacaaactttagaattagaagagatgaagtctacaaaacacggtgggagtcagagaagagaggatagctctggggaggtatactggatcagaaacagaaatggaagaaatagaacagctgcataagcaaactattaagaatcactaagcaagcagagaaaggaaagagagggaagagtacacctactatatgttaggcactgttcactttatgctgtttagttcaccgaccttgtgaggtgggggtatcattttctttttatagatgaagaaagacttgatgaggtcaggtaacttacccaagatcacacaacgggtaggtagtgaagccaggatttgaattaaattgtgtaatactgttatatcatgtccctttcagaggaaggattaggaaccaaaaagggcctatgcagtacaaaatacatcagtgagtgtcagtgagtggcaactgccagacacaacagccaccttgaatctaggcatcgtgcacatgaggcacagggtttcctgtcacatacttccctggaagtcctgtgataggggtttggagtggtcccatcttccagtagttgtctcactttttattcctccattttccctactcccagaggacactggcaaggatgcagtgaattgtacctataagaatgaggatgactgtgtcgtcagattccagtactatgaagattctagtggaaagtccatcctgtatgtggtagaagagccaggtgagtgaaccctgacggctcccggccctgccccaggagggagagggagaaccatgttaggcaggaatctctactcatcgaagctgttaagcaaaacaggttaagcctgcaagtgataagttaggggccaggtgtggtggttaacacctgtaatcccagcagtttggaaggccatggtgggtggatcgtctggggtcaggagttcaataccagcctggccaacatggtgaaaccctgtctctactaaaaatacaaaaacattagccgggcatggtggtgcatgcctgtaattccagctccttgggaggctgaggcaggagactcacttgaacccgggaggcacaggttgcagtgagctgagatcgcgccactgcactccagcttgggcaacagagtgagactctgtctcaaaaaaacaaacaaacaacaacaacaacaaaaaaaaacgataagttagggaccgtcatctgggtgaagggcatttataaatacaaatattatcaagaaagtgacttgttaattgaggagacaggaaaatcagaaagcaggtaaggagaagaagatagatatggatctcattaatggacaaaatatatcacgcatttttttgaggcaatgatgtcaagaaataaagaatttaaattttaggactttacagcacatggcatctgcactattaaaattgagatggttgccaagagcaacttgactgtgcttcagaggaaggcctgatggttagaggtgttacctttccaagtttactgcaggatgtagggataggtttgaggcactaaggcaaggctgccctgaacactgaaagtacagtgccttctgggagcaggaggaatccatcccatcatacacagaccagccacaggtttgtcaccaaccaatgctgtcgatcgcttgcttccctttaacaccttcatggcctttgttctccttaaacaacaggttaagatgaattattagaaaacatttttgagtattcactgccagtagaccccttcccccacattaggagaacagaccccagatccatagacccacgtttcctatctttttttttgagatagggtctcattttgttgcccaggttggggtgcagtggtgcgaccttggctcactgcagtctcaacctcttcggctcacacaatcctcccatcccagcctccctgggactacaggcgtacactaccacacctggctactttttaatttttatttttttgtagagatgaagtctcactatgttgccctggctagtctcaaaactctgggactcaagtgatccccccgcctcagccccccgcaaagtgttgggattacaggtgtgagccaacacacagggccaacatttcctatgttgttgctctggaattctaggctccgcctccctgctcatctcccagctccaatcatttcctggctttgagtagaatgttgcagctggggcctcagacagtgggggagatgattctctttctcttccccaactcatgctcttgcagatgctctctttgaagggctaagccactatagggcagtaaagacaacactgccaaaagttttggcattggccaaatggaatttaaccacatggaatgggctcttgagctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgcccaccaccacacctgactaacttttgtatttttagtagagacagggtttcaccatgttggccaggctggtcttgaactcctgacttcaagtgatctggctgccttggcctcctgaagtgctgggattccaggtgtgagccactgcacctggccaagcatcctgtgtttttgtttgctgaatctgccaaccctacccagacttctctgaccttgggtcatttgccattggtccaccgctgtggctggaagggccctccagaggtcacctgatcttgccttctgcttccaggaaacccaccccaaactcctttcaggacacatggttaacagattgttttcccctaaagacctcctggcaccctacctgccctgcccatactaatgtgcagaattaaagagattttactttgataattgagggtcagccctacccaaatcttccagagaatccataattgtttttcccagaactggggcccttcactcttgggaacttgaacactggaacctcacagcctctctccaggcactcatttaattatagacaggttgtaatttggcgggttgggagatagccagcttgagttatggtggtggttgtttttgtggtgtgtgtggtgagcattgggtatatgtttggcgaagaaggtgggagacagtgtggaaagtgggtgtgacttcctctccaggctcattagcaccctcatatataaacacctggtttcataacacttgaggttactggaataagatcacctattagatacctgacatttgtgggaagcagagctctgcagagtatactcagcctgacccccagaggggtgacatgcctctgttttagttgttgactggggttgaacaggaaggcagctttcaatagggttatgattttagatgactaagtattttgggaaagaacccaaaatattgtcttggctggcaggtcctggtctctaagaatgcaaaaaatgtcattaggttcacagccctcaggaatgtaaatatctgaaccaggataacagacacaaatacttacagtggctaaggaagcaaataagttagtgaaaacagctgggtgtaagaagatccgttacaacggtagctgatatttactgagcacttactctgtgccaggcattgttctgagtttttaagatatatttaatttaatcattcctcataacaagtttcttttaaagtcagtgctattactatcttcattttaaagatggagaaacaggaaacagacattcagaaaggttaagtaattttccaaagatcatgtataaaagttaagtgataagtcaggattcaaacccagggagtctggctgtaacatccacaggagcgcagacacaccaacaagtcacactgccttcctctaggagagagaagggagagtggtggggattctggtaaactagaaaacatgagttccaactaaaaggagcagctcctcctcagctctagctaactgctgctctgcaggaatataagaatctctctctttctgtatttctctctttctttcttttgagatagtctctccctctgtcatccaggctggagagcagtggcacgatcatggctcactatgaccttgacctcccaggctcaaacgatcctcccacctcagcatcctgagtagctgggactacaggcatatgccacaatgcctggctaattaaaaaagacaattttgtagaggcagagcctcactatgttgcccaggctggtcttgaacttctggactcaagctgtcctcctgcctcggcctcccaagtgctggcattataggcatgagccactgggcctggcctggattttctttttaaagagactaatatgaaattttagggggagaatctcctgattattcaatattgccaataaagtcaattttttatttcttattcatttatttatttatttatttattttgagatggagttttgctctgttacccaggctggagtgtaatggtgtgatctcggttcactgcaacctctacctcccaggttcaagtgattctgtgcttcagcctcccaagtagctgggattacaggtgctcgccaccatgctaggctaatttttgtagttttagtagagatggggtttcaccatgttggccaggctggtctcaaactcctgacctcaggtgctctgcccaccttggcctcccaaagtgctgggattacaggtgtgagccaccacactcggctttttatttttaattttttaaaaaacttttatttttgctttaggggtacatgtgtgggtttgttccgtagataaactgtgagtcatgggggtctggtgtacctattatttcatcacccaggtaataagcatagtgactcataggtagtttttcgatccccacctcctccccgtctccaccctcaagtaggtcccagtgtctggtgttctcttctttgtgtttaatttttaaaataaacacttgggtgaacccccacacaaaggtgtggctgggttctgtctaggggttaccaggtctagacttctgatttgagccactcagtgcagattattgctgtcctaatgattgtctccttaaaaaaattaatttttgaaaactgtcctatttccttcaaggaccttagttactttgtcaagaacacctttttcatagccagttcaagtgactcctgcttcattcacaaccgccctgctctgtgcttcttcctcacagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagtaagagacggggctgggcgttttctaaagtcattggtctgagactcttaagtggaagcagcagatgctttgggtggtcatgttcagccagtaccatcgtctttccattatcctctgttctggaaactgggagagatggtctcactatccccttgtccttcagcttccttcagcctcttagaaatagtggcaggatgtcattccatctcattctcttctttctcctcaaataaatggttacttccaggctgggcctggtggcgcgtgcctgtaatcccagcactttgagaggccaaggtgggcagatcacttgagctcaagagttcgagaccagcctgggcaacatggtgaaaccccgtctctattaataatataaaaattagccgggtgtggtggtgcatgcctgtaatcccagctattcgggaggctgaagcaggaggattgcttgaacccagtaggtagaggttgtagtgagctgagattgcaccctgctctgggtgacagagcaggactcggtctcaaaaataataataataataataataataataaaataaaataaaaggttacttccaaatcagactctactcttttatcctgatttattccaattaaataagcatttactgagaactttctatatacttaatcttactctattctcttttggctcttctttcacatttcaacttttttcctcgaccctccaaatggctatttgactccccaaatgtccagagttaggctgcaagtttgttcccatttgatgttgaccccagagctttatactcaagggtcccaagaaactgagatgtttctgttagaacagtgtggaacatcctgtacctatgaggcccacaggaatgtgtttctttctctttttttttggagacagagtcttgctctgtcacccaggcttgagtgtagcgatcttggctcactgcaaccttggcctctcaggttcaagtgattctcctgcctcagcctcccaagtaactggattacaggcgccagccactgtgcccagctattttttgtatttttagtagcgacggggtttcaccatgttggccaggctggtctcgaactcctgacctcgtgatcacccgcctcggcctcccaaagtgctaggattccaggcgtgagccactgcgcctggctaagaatgtgtttcttgaagctaccattataggatttgttactttctgttggaaaatagtttgggaaacctagtgagggtcttactttttcctgataacatgacagtttgtggatagtgctttctctttctctcccctcctctcccattccctcccctcccctcccctctcctcccctccccttccttttacgcttcctcccctccccttcccttcctcccctcctctccttttctttcccttcccttccctccttccttctttttttgagacagggtctcgctctgtcacccatgctggagtgcagtggtgccatcatggctcaatgcagcctccatctcctgggctcaagtgatcctcccacctcaccctcccaagtagccaggactacaggcacacatcaccgagccagctaatttttgtatttttttcccttgtagagacagggtctcactctgttacccaggctggtctagaactcctgggctcaagtgatcttcctaccttggcccctaaaagtgctgggattataggcataaaccaccatgcctggccatggttagtgcttggccagattagatgaaaacaaattaataattatttgagcaaaagctttcctctgtgttctgaattgcacctgatacatttctgtcccttgtccacatctcctatcactgtcacagggaatggaaaataggagaagggcaaaagagacggggacacaggggtgaaataggagaggttctatccccgaatgctgtggaatcactgaagagtgataggctgaatatagctccttagaaatagtggcagggaacaggtgtggtggctcatgcctgtaattccagcactttgggaggctgaggcaggtggatcgcttgagctcaggagtttgagaccagcctgggcaacatgaagaaaccccatctctacaaaaaaatgcaaaaattagccagacatggtggtgtgtgcctgtagtcccagctacttgggaggctgaggtgggaggatgtcttgagtcaggggaggtggaggtttcagtaagccgagattgtgccactgcactccagcctgggcaacaaaatgagaccctgtctgaaaaaaaaaaaaaaaaaaagaaacggtggcaggatggcattctacctcatctcctcctgttatttcctatcaattcccatgccaagaactaaagtgtgagcaaaatgaacattattctgtttcattgatgatgtattccagagaacggtgccttgggaaaacttctgagatgaattttaaacattcagggtagggaaggacttaaggaagtcactgtaagatgctattctgtttcctccacaggccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaatttttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttctttttttttttttttttgagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctgtggttgaaatttcttaagtgccttcctcacttcctaaccaccttctctgtttgggtttgtgcaacagtaaattaaatgtactttccaaaaagaattggcctaaggctgctcagtgcttcctgtgttgttatttctgtttcctttggatgaaaagaataggtgtcattgactcagaaatgattattttagaacaagcatgtttccaaatgtaacagaatgatgactactatgggtactgaagctagcttcagaatccagagcttctctttagatttttttgttgttgttgttgagatggagtctcgctctgttgcccaggctggagtgaagtgagcgcgatctcggctcattgcaacctctgcttcctgggctcaggagattctcctgcctcagcctcccgagtggctgggattacaggcgcccaccaccatacctggcaaatttttgtatttttatttatttttgagatggagtctctctctgttgcccaggctggagtgcagtggtgtgatccctgctcactacaacatctgcctccggggctcaagcaattctcctgcctcagcctcctgagtagctgggattacaggtgtgcatcatcacatccggctaatttttgtatttttagtagagacagggtttcaccatgttggccaggctggtcacaaactcctgacctcaactgatccgccggcctcggcttcccaaaatgctggaattacaggtgtgagccaccaggcccggccctctttagacttaatattttttaaatgagtaggttattactgttctaagagtttgcggttttttttttttaattgggtattatttaggaacttgtgcaacctcaaaagaacagactgccagtgtagcctagattttgtttgtaggaagcataaatggataaaataatagcttaatggcaaattatttacaggaccatttaaatgcctaaattttatttaaggcagtgggtgtcaaagtgtggtcccaagaccagcaacatcaatatcagctggaaacttgttagaaatgaaaattgacaggccccaccccacagctgctgaatcagaaaatctgggagtggggacccatgatctgttttaagaagcctccctggtgattctaattcatgctcaagtttaagaacaactgatttaaggaatcacatatttagccttcttgcctagaaagaactttatagtaaggcagcttagttactatatacagttaatagcaaaccttgcctgacatactcagaagatgaaatatccacccacacaaaatgaaaatctactttgacctattttccaggttaaatgatcttgggtatcttgctttcactcatgaccacaaattcccatgaaaaactggaagaatagaatcctggggaaaaactaacaggatactttttatgtgtactaagacacaagcaaggaaatattcttacagaatttattcacaggagataggatcaaaatcttaattattaacattatcatcctataggatgctagaataatacttagaattttttactttacagccaaaaggctgtttaaaatttattgaacaccaacagtgtgggactgaagtaccttacagaacactgataacataatctttgtctttaagtcctttttttttttttcagacgggatctcattttgttgccagaatgcagtggcatcatcatggccactgcagccttgacctcccaagctcaagggattctcctgccttggccttccaaagcgttgggactacagacacatgccaccatactcggctaattaaatacatatttttttgtagagatgaggtctcactatattgccccggctggtctcaaactcctgggctcaagcaatccttccacctttacctcctaaagtactggaattacaagtgtgagctacggtgcctggcctgagtcttaaattcctaacataatgtacattttttgagcataatacaatacatgacatcattaagagattacgtgaacatagactgagaccttttatggtgaaatcttgtgagattcactatgttttatttacgtcttggtaactgctgactaaatgtctggatgaaaatagaggatcttatgtaaaatgagatgaaaagctatatgtcaagccacatttgtaatcctttaacgcttggcttcggtagtccaaactctacagtaacagagccatctaatggccactgggaccaattacaagcagattgcctgggaattactcagttttcacagtataatggaaccataacgtatgctctgcaaataagccatttaaaaatcatttctaattggttttataatacaatatatttatggaagtatatattcctaatttgttttagtttggttaaaacatgcaaggaggcagtcttagaagcttgtgattagggttaagtatatcattacataaaaatttaaaaatccacttaatgtggctacctaagaatggtttgtatgtgaaaagaaaatgaagaggtcaggaacatgactgccttccttgaggctgctaatgttataatgaagcccctccaactccttgcataaaggaaacactttcatcagctgtatattttctgacacatcaaagattgctcacagaaagcaccatttagaaaatttaggagcctttaaacaaaatgtccattttaaattattctttagcagtgtccccaataagaacttgtaaggaaaacgtttcacaattgatttcattttagtatagtaattggattttccagtgactcatacagaattggcttgattctttggagagatcacagtgatgatgtgtaaatatcgctttggtggccaatggaaatacttcgttaagaaattggaaaaaaatgttgatgggtgtgtgctggactttgcctttcctgacccttacactcaccattgtgacagagattgctgattgtgcccagtatgttttctccttctcacataatattagaacttctgctgtttagttgggcacatggttgcccagaataaatattcttttattactaataagcaaatttagtaaagttgctagatacaaagagcatgcaaaaatcttgtagctacatgtgccatgtccatctcatagacaatgagatgtaaatgaaagaggtgtatgcaacttccagtaaatgctgtttaagggaaggaacatacttttctccatttccttcatcttgcaggcgggaatgcagagttaatacctagaagttaagtagccctcatagctcaatatgtgaccttggggattgtattattttatttatttttaaaatttttttaaggaggtaaggtcttgctttgttgcccaggttggactcgaactcctgggttcaagcaatcctcccacctcaacctccccacgtagctgggactacaggtgcatgccaccacacccagtggggattgtattagttatctgttgctgcataagaaattactccacaatttagtagcttaaaacaacaaacattatcttgctgtttctgtggtcaggaatttaggaatggcttagctgggtggttctggctcagagactctcatgaggttggagtcaaactgttggccagggctgtagtcggttgaaggctaaaaagggctggagaatccttttctaagatggcttactcacatggctgttggcaggaggcatcaattccatgctggctattggcaatagaccttagttcctcaccacttggatatctctataggactgcttgagtgtctgcatgacatgtcagctagtttctcccagcgggagtaatccaagagagaacagggaggaagctacaatttttttatgacttagttttgtaagtgttacaccataatttctgccatacactattcattagaagtagcccactaaatccagctaacattcaagaggagggaaatagatgccacctcttgaagggaggagcattgtgtacagaatcattgccccccaaagacagccacatccccatctccagaacctgtgaatatgttaccttacgtggaacaaacaactttgttgacataattaatgatctttagatgaggcaatcatcctggattatctggggaggctcaatgtaatcacaagtgtccttataagagggggtcagggctgggcttagtggctcatgcctgtaatcccaggactttgggaggctgaggtggttggatcacttgaggccatgagtttgagaccagcctggccaacatggcgaaaccctgtctctactaaaaatacaaaaaaattagttgggcatggtggcacgcacctgtaatcccaactacttgtgaggccaaggcataagaatcgcttgaacccaggaggcaaaggttacagtgagccgagattgtgccacagcactccagcctggatgacagagtaatactctgtctcaaaaaaaaaaaaaaaaaaaaaaaagagagggagttaggggggccagagtgagagtgaatggaagtgggtcagactgatatggccataagtcaagcaatgtatacagcccgtagaagttggaaaaggcaaagaatggattctcttccacggcctcaataagaaatgcagcctttgattttaacactgtaaggctcattttgtacttctggcctccagaaacttgggatgataaatttgtgctatttaagccactaagtttgtggtaatttgttaccacagcataggaaatgaatacaaatatcaaagtgtttgtggacatattttaagactacctcaggcaaccctctggtcacaaattatttatagttctcccacatgcaaaataaacttaccccttctaaggccccaaagtcttatcccattatagcatcaattcaaagttcagaatcttatcctctacgtaagtccagggaagatgagacttcttgggtgtaattccttaaatacagctactcaagtacatgcttttcaatctgaagttctgcgaacaaaaagaaaaaggtcatatgctcctttccccacagcaaccaatgtaaaacagcaggggcagggagataactgctatagacactcctgttccaacaggtggaaaccaaggtgcacagaagtcactggttcatagcaattctgaaatccatttgagtacaggtttgcagttctacactcaaagcctgggaataactccctatggcttttggttccaccttctgggctcttggttttatcctctaagtcatccttttttgtgtgaaagggagatgtgtttggacctaaatagttttcttagcctgcttcctgtttgtagaaatgcgtttgtagaaagggtccaaaggcccctttcctttttgtactctttttcagctcaagctgacagtatttctgacaatacaattctcttaaaacaatttttgaatctactgtgaatcttactgggttttagtccaggagacaaaagccatggcagcaaatacctttgagatatgtctttttctaccttgggcttctgctgaaggacaaagaccttaagtttcttagaagccctattgtttgaatgagaggacctgtgagccatactcttaaaatcttttttctgagacggagtcttactctgtcaccgaggctggagtgcagtggcgagatcttgggtcactgcaatctccgcctcccgggttcaagcaattctccagcctcagcctcctgagtagctgggattacaggcacccgccaccacgctcggctaatttttttgtatttttgtagagatgaggtttcaccatgttggccaggctggtctccaactcctgacctcaggtgatccacccacctcggcctctcaaagtgttgggattacaggcgtgaaccactgcacccagccactcttaaaatctttagagagtctttgcctgattgaacagtactccgaggtaccatccttaaacacaacaggcgtggggagtgggaaagcgggtgatggagggtggattgaggggtatttacaaaaataaaagacatggtctcagcactcagatatttcagaatctttggggagataaactatatacatttaaaaagcactaaagaattacaggtcatatccctaatgagtatagatacaaaaatcctcaacaaaatactagcatactgacttcaacaatacattcaaagaataattcaccatgatctagtgggatttatccctgggatgcaagtatggttcaacatatgggaatctataaatgtgatacaccacataaacaaaaatcatatgatcatttcaatagatacataaaaagcatttgatgaaattaaacatcctttcatgatgaaaattctcaacaaattaggtatagaaggaacgtacctcaacacaataaaggtcatatatgataagcctacagctaacattctcaacagtgaaaagttgaaggcatttcctttaagatcaggaacaagaaaaggatgcccactcttactgcttttttttttttcaacatagcactggaagttctagtcagaataattaagcaagagaaataaaaggcatcttaataggaaaggaagcattggaattttctctttgttgacaatatgatcttatatatagaaaacccaaaagactccaccaaaaaactgttagaactaataaagtcagtaaaattgctgtacacagtcaacacacaaaaatcagcagcatttctagaggccaacaacaaatccaaaaaagaaattaagaaaataattctacttatattagcaaaaaccaaaactgaaacaaaaaaggtgtaaatttaaccaagaaagtgaaagatctttatactaaaaactaaaaaacactgatgaaagaaattggaaaaaacacaaataaacgaaaagacatcccatgttcttggagtggaataattaatataattaaaatgcccatgctactcaaagtgatctatagattcaatgcaattcctatcaaaattccagagttatttttcatggaaataaaaaaatcctaaaattcatatggaaccgtaaaagatcccaaataaccaaagcaatcttgagcaaaaagaacaaagttgggccaggtgtggtggctcacgcctgtaatcccagtactttgggaggccgaggcgggcagatcatgagatcaggagttcaagaccagcctggccaacatggtaaaaaaaaaaccccgtctctactaataatacaaaaaaattagccaggcgtggtggtgcgcgcctctagtcccagctacttgggaggctaaggcaggaaaatcacttgaacccaggaggtggaggttgcagtgagccgagattgtgccactgcactccagcctgagagacagagccagaatccatctcaaaaaaaaaaaagcaaaaaaaaaacaaagttgaaggcatcacagtccctgactttaaaataaacgacaaagttacagtaatcaaaacagcatggtattccataaaaacagatgcattggccaatagaacatactagagagtccagaatttacagacaattgaattttgataaggagccaagaacactcaatggggaaaggaatctctttgataaaaactgttgggaaaccatatatccatgtgtagaaaaatgaaattggacccttatctcacaccgtatacaaaagtcaaaatggattaaagacttacctgtaagactggaactactagaagaaaacatagagggaaagctactagaagaaaaaatagaagaaagccactagaagaaaacaggcggaaagctccactacattggtctgggcatttttttggacatgacctcaagaacacaggcgagaaaacaaaaaataaacacatggaattacatgaaactaaaaacttctgcacatcaaaggaaacagttaacagagtgaagagacaacctgctgaatgggagaaaatatttactaattatacatctgacaagaggttaatatccaagatatacaagaaactcagtagcaagaaagcaaataacctgattttaaaaatagacaaataatctgaatagacttttaaaaaaaatttttttttgtagagatgaggcttcactatgttgcccaggctggtctcagattcttgggctcaagcggtcctcccaccttggcctcccaaagtgctgagattatgggtgtgagccaccatgcccagcctgacacagccattcttaaaagaagacatacaaatggccaacaggtttgcgaaaaaaaaaatcactattattagggaaatgcaaaataagattacaatatcacctcacacctgttagcatggctattaagctgggtgtggtggctcacacctgtaatctcagtactttgggaggctgaggtgggcagattacttgagggtcaggcgtttgagaccaccctggccaacatggtgaaacgccatctctactaaaaatacagaaattagccaagtgtggtggcacatgcttgtaatcccagctacttgggaggctgaggcaggaagattgcttgaacccaggaatggaggttgcagtgatttgagattgtgccactgcactccagcctgggcaacagagtgactcaatctcaaaaaaaaaaaaaaaaaaaaaaaaaaagaattgctattatcaaaatgatgaaaaaaatgtgttgctgaggatgtggagaaaccttttacactgttagtgttattacagccattatggaaaactatatggaggtttcccaaaaaattaaaaatagaactaccatatgatccagcgatgctatttctgggcatatattgagtaactgaaatcagtatatcaaagacttatttgcacttccatgttcatttcagcattatgcacaatcgctgagataatggaatcaacctgtgtccatcgatggatgaatggataaagaaaatgtagtaaacatatgcaatggatactattcagccttaaaaaagaatttctgtcatttgtgacaacatgaatcaacatatgcaatggatactattcagccttaaaaaagaatttctgtcatttgtgacaacatgaatcaacttggaggacatactaagtgaaaaaagccaggcacag

SEQ ID NO: 1115 - DNA, 41840 bp, Homo sapiens
agcctgggtgacagagtgagaccctgcctcaaaaaaaaaaaaaaaaaaaaagactaatgtgttttgtgatgatcattttctgacatttgttttgtgtctaatgtctaccattctaagtcctcaatgctaaggactcccatgggccttggtagagacctcggttcaagtcctgcacttacccttccctgtctgaccttggcaagcagccctctccctgggcctcagtttccccactttgcgttgcaatgcctctctagttatcaagctcctggaagtgccggtgggtccatggctgctgggggacaagcccacacagggactgactgaggcttgtccctttttctagagaaaatgcaggaagctgctttgggtcgtttatttactaagagacagcaagaaggggtgttacacatgcagggagcggagcgtctggggctcccctggagtgaggacatttggctgtcagtgtccagcatctgtgaaagcggggatcctccaagccagggctagggtgtgatttattctgcagttgactccacaggctgcaggtggcattggtctggggtagatagtgagcacccatcccaggaggtaatcaaaggcctgtagatgcgagactttatggtgctgtgtggcctcaggagctcaccagaccagaccctctgggcctcaggccactctgaggctgcacccaaggaggaatcagtagggacagagggtcagcaggtcttgttgggtacagccactgaggcagcagtagcgtgcagggttggtggcagctgcacggtggtggcggtgatggtgagaggtctggggcaggggctgcaggccaggtcccagcgtgagattactgtcggccaccagcccatggagcagatgtcgtctctccagccactgtagcaactcacctggggacagagtgaaactcagctggaacggaaacgacagaggacatgctaccccatgctgcatgtgcacgaatccacacacatcccactgagtaacccaccaaacactcatgcatgcagataaaaagtgagcactggccgggtgcagtggcttacacctgtaatcccagcactttgggaggccgaggtgggcggatcacgaggtcaggagtttgagaccatcctggctaacacagtgaaaccccttctctactaaaaaaaaaaacaaccaaaaaattagccgggtgtggtggcgggcgcctgtagtcccagctactcaggaggctgaggcaggagaatgacgtgaacccaggaggcagagcttgcagtgagccgagatcacgccactgcactccagcctgggtgacagagtgagactctgtctcaaaaaaaaaaaaaaaaaagtgagcactggcccggctcagtggctcacgcctgtaatcccagcactttgggaggccgaggtgggtggatcacttgaggtcaggagtttgagatcagcctggccaacatggtaaaaacctgtctctactaaaaaatacaaaaattagtcaggcgtggtggtggacgcctgtaatcccagctactggggaggctggggtgggagaatcacttgaacccaggaggtggaggttgcagggagctgggatcatgccattgcactccagcctaggtgacaagaatgaaactccatctcaaaaaaaaaaaaaaaaaaaaaaagcgagcacttattaagcacctactgtacgccaggcacctggttaatcctctcatccactcaactcatgtccacactcacatccccagctgcgtgggtccccatatgccacctgagtgccccatgccctgcccagggagtgtcgggggtcttggagctacagatggtgtcagtttccccaacaggtccaagggtccgtgagacacccagagcaggtcagagacccacccacagactcctcgtggtacagagacatgcaggggtgtacatgtgtctgtgggtccacttcctggtcacccacgcatgtgtggtggacccacagacacacacacacccctacgaggacacacccttgcagaccacctcccctggatccctaacaccgcaagtggagtggcacacagagacatgtggacacgtgttaacacatctgcacaaacttgtcgtatatccctgcaccagggccaggactagggtacagacagggaggcacgaagccatcaggatatttttttgaggccaggcaccgtggctcacacctgtcatcccagcattttgggaagcctaggtgggtgcgttgcttgagcccaggagttcatgaccagccttggcaatacagcaaaacctcatctctgcagaaaatacaaaaattagctgggcataattctgcatgcctgtagtcccagctacttgggaggctgaggtgggaggatcgcttgagcctgggaaggcaaggctgcagtgacccgagatcgtgccactgcactccagcctgagtgacagagcaagactgtctcaaaagaaaaaaaaaaggacttatgaaaatttagagggttgtttaccctctacccaatctgcagtttacaattgacaccagtggttctcaaaccagggtgattttgtttccaggggatacttgtctggggacagttttagatgtcacaacttggatggggtgtgaggctattcatggcattagggggcagaagacagagatgttatctaacaccctacaatatacaggacagccccactaccatatacatccccaaatgtcagcatcagctttttttttttgagatggagtctcgctctgttgccaagctggagtgcagtggcgtgatcttggctcactgcaacctccacctcccgggttcaagtgattctcctgcctcagcctcctgagtagctgagactacaggtgtgcgccacaacgcccggctaatttttgtatttttagtagagacgaggtttcgccacgttggccaggctggtctcaccagcctgagagtagctagtcacagctactcaggaggctgaggtgggcagattgcttgagtctgggaggcagaggttgcaatgagccgagatcacgccactgcactccagcctgggtgatagagtgagaccctgtctcaaaatatatatatataataataataatattaatatttttcccttttttgagacaagggtctctgtctcaggctgagtctcatattgcccaggttggtctcaaactcctggcctcaagtgatcttccctcctagcctcctgagtagcagggattacaggcatgagccaccacatccagcaaggtaagtattttaatgcaatacttttaaaataaaatttaaaatatttgtaaaaaggccaggcacagcggctcacgcttgtaatcccaacactttgggaggctgaggcgggcagatcacctgaggtcaggagttcaagaccagcctggcccgggcacagtggctcatgcctgtaatcccagccctttgggaggccgaggcaggtggatcacgagatcaggagattgagaccatccttgctaacatggtgaaaccccatctctactaaaaatacaaaaaatttagctgggcttggtggcaggcgcctgcagtcccagctactcaggaggctgaggcaggagaatggcgtgaagccgggagacggagcttgcagtgagccgagatcacaccactgcactccagcctgggggacagagcgagactcaatgtcaaaacaaaacaaaacaaaacaaaacaagaccagactggccaacatggtgaaacctgttgtttcacctgttcacctgtctctactaaaaatacaaaaaaaaaaaaaaatcagctgtgcatggtagtgggtgacctggggagtggcctgtaatcccagctacttggaaggctgaggcaggagaattgcttgaactcaggaggcggaggttgcagtgagctgagatcgtgccactgcacttcagcccgggtgacagagcgagactccatctcaaacaaacaaacaaaatacaaaaattagccaggtgtggtggtgcgtgcccgcagtcccagctactctggaggctgaggcaggaaaattgctggaacccgggaggcagaggttgcagtgagacgagatcacgtcacagcactctggtttgggtgacagagcgaggctatgtctcaaaataaataaataaaaataaaataataaaataaagtaacataattgtgaaaagcaatacttttcaaaagcaatacttttaaatacttttaaagctggacacagtgactcacatcgctaatcccaacactttggaaggtcaaggtgggaggattacttgagctcaggagtttgagaccagcctgggaaacagagtgagactccctctctacgaaaaagaaaaaaaaattagctgggtgtggtggcagcacctgtatcccagccactccagaggctgaggcaggaggatggtttgagcccaggaggttgagcctgcagtgagccgagatctcaccactgcactccagcctgggcgtcagagtgagaccctgtctcaaaaaacaaacaaacaaagcaaaattaaggcaaaaattcatgaagatcaaaatattgaaattttaagacaggatctcaccatgtacttgcaagagcctacctctcctgcctcactctgtttctggcccctcagggggactcatgctctgaggactttcttttttttttttttttgagacggagtttcactctgtcgcccaggctggagtgcaatggcatgatatcggcccactgcaacctctgccttccgggttcaagcgattctcctgccttggcctcccaagtagctgggattacagatgtgcatcattatccccggctaatttttttaaaaattatttttagtagagatggggtttcaccattttggccaggctggtctcgaactcctgacctctggggatccacccgcctcagcctcccaaagtgctgggattgcaggcgtgagccaccacgcctggctaacggctctggggactttcacacgcgcgttcacacacactccagtgcggacccacgatctgtgcacgcagccggcaggtgagccctgggcacatgcatgcaaacctgcccacctccctgcacgtgtgcatctgcgcctacgtgcacctgccccacctcggcttcccagagcgctgtccctgcccgtccccactcacggtcgcctccggtcgcaggcctcctggcttcggtggaccagcgggggcccccgcacacgcgcactagcgcgcgtacgaagtggtggccgcacaacttctcacgcatctctggggtgggcgcggggcccaacgcgaacaccagggcagggcccagcagcaccagcgcccaggcgggcagacgggggtccatggtggtgggtggcgccggggccaagcggggaccccctttataggcgcctgggccgtcccagctgggggccttggagaagggacagaacattcttcaggaccgcccaggaaaaaggtcaagggtggggttagtgccagagcctttctcccagggccagggccttggatgtacttctcccagagggagcactgggcaacgagtctttcttttttatttttttcttctttttttttgagatggagtctcactctgtcacccaggttggagtgcagtgacttgatctcggctcactgcaacttctgacacccgggttcaagcgattctcctgcctcagcctcctgagtagctgggattacaggtgcgcaccactatgcctggctaatttttttttttttattttttatttttagtagagactggggttcgccatgttggccaggctggtctccaactcctgacctcaagcgatccatctgcctcggcctcccaaaatgctgggattacaggcatgagctgtgcctggactattattatttttattattattattgagacaaagtcttgctctgtcttccaggctggagtgcagtgatgcgatctcggctcactgcaacctccacctcctgggttcaagtgattctcccacctcagcctcccaagtagctgggattacaggtgtaagccaccacgcccagccacctatttttattttttatttttgagatgagttcttgctctgttaccctggctggagtgcagtggcacgatatgggctcactgccacctccctatccctgactcaagcaattctcccacctcagcctcctgagtagctgggactacaggcccacgccaccacacccggctaattttttgtattttttttgtagagatggggttttgccatgttgcccaggctggtctcaaactcctggactcaagtcatcttcccgcctcagcctcccaaagtcctgggatcacaggcgagagcgaccacaccagggtatttattcatttttgacataggatctctctgggttggcctgtaatggcaggatcatagctcactgtaacctcattcccctgggctcaagcgatccttcagcctctgcctcctgagtagctgggactacaggcctgcaatacaatgcccagctaatttttaattttttaatttttatttttatctttttagacagagtcttactctgtcacccaggctggagtacagtggtgcgatctcgactcactgcaacctttgcttcctgggttcaagcgattctcctgcctcagcctcctgagtagctgggattacaggtgcccaccaccaagcctggctaatttttgtattttttagcagagacggggtttcaccatgttggccaggctgatctcaaactcctgacctcaagtgatccacccgcctcggcctcccaaagtgctgggattacaggcgtgcaccaacgcgcccggccatttttaattttttaattgtagaggcaggggtcttgctatgttgcccaggctcatctagaactcaagtggttctccctactcggccttccaaaatgctgggattacaggtgtgaggcaccacacacggccaagtcttcgctattgtcttaaccagtttaaagagatgaaatagatcaactgaaaagtaataatcctgccttttctggggggcaggggggaagacagcgggcatcttccaagaccagaaatgttcagaattttgttgtttctattactgtacaaatgagaaaactgaggcacacaggccaggtgcagtggctcatgcctgtaatgcaagcactttgggaagatggggcaggtggatcacttgaggtcaagagttcgagaccagcctgcccaatatggtgaaactctgtctctactaaaaatacaaaaattagccagatgtggtggtgcatgcctataatcccagctactcgggaggctgaggcaggagaatcacttgaacccaggaggtggagattgcagtgagccgagatggtgccgctgcacaccagcctggggacagagactccgtcccctcaccagacaaaaagaaagaaaagaaaagaaaaaaagaaaactgaggcacagagaaaggaccccaaacttgcccaaggtcacaggaggctgagcagagcccaggtcttctcaaggcgcctgacacgcagggctgggggtgtcccatccgaagctctgtctccccaacacggttgtcccctctgggtgagcaggggctggtggacccagaatagagcaggatttatttgttcagtggatgcttggcccccgcttcatgcctagggggtcttatagctttgtttttccaaggagggaatctgaggttgagagagggaaggatgcttgaccctaggcaggagagaacctgggctggaactcgagtcttgcttgaccccagagcagctccctccctatttctaccaaattagggggccctctggggctaagagagcagggacagggatctctctctctctctctctctgagtctctctcggccttcatctctcagtttccttctgtatgtctgtctctgtccgcatttttcttttttttgaaacggagtcgctctgtcgcccaggctggagtgcaatggcatgatctcagctcactgcaacctccacatcccagtttcaagcaattcttctgtctcagcctcctgagtagctgggattacaggcatgtgccagaacaccaggctaatttttgtatttttaatagagacggtttcgccatgttggccaggctgatctcatactcctgacctcaagtgatcctcctgccttggcctcttaaagtgctgggattacagacgtgagccactgagcctggccactctccacatctttctagcagttatgaggtgcacatgacgggggccggtcggtggggaggtggtccggccccagtgatgctggtcccctccccacagcctcgctcccccaacctggccttgtcctctgaccaccgggagagcatcctgttccttccccacccacagagagcctgtaatcagctcccccaggctgcagccaaggccagcagctggggctgggagtgagggggctctgtccttgagggccccagccaagccccacccagtggtcctcctccaccagcctgccctggggcccccacagtggctccctgagaggtctctggcccacagctctaaccgcatccctcccagctcacacaccctctgaggctccccatcgccccaagtccagcacaaaatcttttccactgaattcctttattcagtcaacaaacatttccagagccccctctgtactgaggcctcagcccagcccccaaggaaccctgaggtcaggggagacagctggacacagacacttccccagccccagggccagagtggggctggagggaaggacagggctacagtagtagtgggggtatatgagggaaggctgcaaggatgtggtagctggagttttgagagatggataagagttttccaaggaggcaaaagtggcagaaaagctttgcaggtgaggaggagcagcagaagcttaacctgcatgagaatccctctcaccagtcagaaagttgaccctgcacagccaaggggtaagctctgaccattttgcaggggacagaactgagacccagagagggaaaggaacttgcccactgtcacactgcatggaaggggcaaaactgtaggctccaatacttgggctcttaacctccttactctgagccttctcacgcttggcatgctgttccctctgccaggaatgcctttccttcccttgattgcgtgaaaagttcctgccaggtttggtgtcatccctttgtgccccttgtagggtgaggacagaaagggtcccattggacaggtgggaaaactgaagccctaggacactcagataccattagggtggactgggaccccagcctttcctgccccctttcaggatcccaaagagatacacgggctcccctaaaaggcagagtcccagccacagcaactgctcttgtccttggcttcctccagagaaacagagatcggggagcagaagtcagatcatacatttaaagctacatgagggccgggcgcagtggctcatgcctgtaatcccagcactttgggaggccgagacgggcagatcacgaggtcaggagatggaaaccatcctggctaacaaggtgaaaccccgtctctactaaaaatacaaaaaattagccgggtgtggtggcgggcgcctgtagtcccagctacttgggaggctgaggcgagagaatggtgtgaacccaggaggcggagcttgcagtgagcctagattgcgccactgtactccagcctgggcgacagagcgagactccgtctcaaaaaaaaaaaaaaaaaaaaagctacatgaatgtccccattggaaataagacaggaaactcaaaactaggtgctgtagtcccagctatttaggaggataaggcaggaggatcactgtagcccaggagttcaagaccagcctgggcaacgtagcaagatcctgtctcttaaaaataataataataaatttaaaaaaaaaaaagcctgggtgcagtggctcatgcctattattccaacactttgggaggctgaggtgggaggatcacttgaggttaggagttcgagatcagcctggccatcatggtgaaacctcatctctattaaaaataaaaaaaattagccgggtgtggtggtgcacacctgtaatcccagctactcgggaggctgaggcaggagaatcgcttgaacctgggaagcagaggttgcactgagccgagatcgcaccactgcactccaccctgggtaacagagcgaggctctgtctcaaaaataaaaataaaaataaaaaaaataaaaagagagagacagaaaaggaaactcagggggccagggcttaaggggttgggaagatgcgagagtcttaaatttggttccttgcttctttgggccaggactcagagagccccactgacacatatgcccatctgtcttgaaccttaacaaattgcaaaggccacaggctattctacaggccacgggagcccccccaaatgcaatgtcatgggggtgttcctgaagtagaggaccctcataaggcctctgaggcccagagaggggcagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcgggggacagataatggggtcgtgcctgagcagtccaaaggacacaactcccattcagcgtatttgtttttgtttttttgagacggagtctagctctgttgtccaggctggagtgcaatggcatgatctcggctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcattcagttttaaaacacaaattaaattccatcccatctctgctccaaaaactcccatggctccctatggatcttacttatttatttatttgagataaagtttcgctcttgttgcccaggctggaatgcagtggtgcgatctcggctcactgcaaaccctgcctcctgggttcaagcgattctcctgcctcagcctcccaagtagctgggattacatgcacacaccgccacacctggctaagtctgtatttttagtagagacggggtttcaccatgttggtcaggctggtcttgaactcctgacctcatgtaatccacccacctcggcctcctaaagggctgggattacaggtgtgagccaccgcgcccagcccttatggattttacaacacacttctcctttcgagactaccctgaccaacatggagaaaccccatcttaactaaaaaaaaaaaaaaaaaaaaaaaaaaaaaaaaaaaaaaaaaattacaggtggcgtgtgcctgtaatcccagctactcgggagtctaaggcaggagaattgcttgaacctgggaggcggaagttgtggtgagccgagattgcgccattgcactccagcctggccaacaagagcaaaaccacgtctcaaaaaaaaaaaaacaacaaaaaaacaccacctctccctgatgccctccttcgctcatctccatccctccttccctcatttgttccgggcagtcacatctgcctccatcgcactggtgcttaaaggcacccagctcattacctccccaaggcctttttcccttccgtgtcctccactggaaatttcttctcctagctttactcatgggtaggctcctcctccttccagcgtcggccccgtaagaggccctctttgaccacccccaccccaccatttccctctgttcatctctttcaaggcacttatcactaccataattttgtctttgttttgttttgttttgttttgttttgttttgttttgttttgttttgagacagggtgtcactctgttgtccaggctggagtgcagtggtacaataatggctcactgcagccttaacctcctgggctcaagcaatcctcctgcctcagcctccctggtagctgaaaccacaggtgcatgtcaccacaccggctattgcttgtattgtttgtagagacaaggtctcactatgttgcccaggctggtcttgaactcctgggttccagtgatcctcctgcctcagcctccctagtagctgaaaccacaggtgcatgtcaccacaccggctattgcttgtattgtttgtagagacaaggtctcactacgttgcccaggctggtcttgaactcctgggctccagtgatccttctgcctcagcctcccaaagtgttgggattataggcatgagccatcgtgcccagcctagaatgttcttatcagattttgctagttactgggaggacagggtcttcagcacccaacaagtcctggcacacagttggcactcaataaatgtttttggcctgagcaaattaatttatcaatgaccaactgcatgtcagacacttccacaaaggttatgattatatgattataaaccatgagagggtgggatgtggtggctcacgtctgtaatcccagcactttgggaggccgaggcaggaggatcacttgaccccacgagctcaagaccagcctaggcaacacagagagaccccatctctttaaaaaaattttttaaaattagccaggcacagtggcttatgcctgtaaatctcagcactttgggaggccaaggcaggaggatcgcttgagcccaggagttcaagaccagcctgggcaacatagcgagaccttgtctcttaaaaaaattatttttatcttatttgtttgtttatttatttatttatttattttgagatggaatcttgctctgtcgcccaggctggagtgcagtggcatgatcttggctcactgaaaccttcccctcccaggttcaagcaattctcctgcctcagcctcgcaagtagctgagatcacaggcacccacacatgggtaatttttgtatttttagtagagacagggtgtcaccatgttggccaggctagtctcgaactcctgacctccggtgatctgaccgcctcagccttcaaaagtgctgggtttacaggtgtgagccaccacacctggccaaaattatttttaaattagccaggcatggtgatgtacacctatagtcccagcactttgggaggctgaggcaggagaatcgcttgagcccacgagttcaagaccagcctgggcaatatagtgaggctcccatctctaaaaaattatttttaaattagccaagtgtggtggtgtacacctgtagctcctgctactagagacactgaactaggggaatcacttgagctcaggagttggaggctgcagtgagctataattgcaccccagcctgggcaacagagtgagcccccatctataaaaaagaaagaaagaaagaaaaaaaaaaaccatgaacgtcaccaccatttatggagcatcgactgtgtgctcggctttgagctgagccctcataggcacaggtgttcaggagtctaatcttccctcaccctataaggcattactattctcattttggaaaagggtaaactgaggctctgaaagtgctctgacttgccacacagtgagagagtagccaagtgggggccaggatcctcatcggcctcacactctagcctttcttctcagtacagagactcaggcgccagctggcttgcccgagaccccggcccaatctacagactgggaaactgaggctagccctgcggcgctcacctcagcagggcaggcaggaggcgccggcagcctctggccctcctccagcagttccaagaggcggcagagggcggggacatcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgaaccgtgaaggggtcagaaaggtgaggaagcgtcctccccactggggcctatgatgctgggaccaggtgaccccatgctaaagagggacgcaggcgcagacaggttggagattggccacgaggggcgtggagggagaagaaggctgggggctctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggacaaggtcttgagatgcgagggtgtagaaaggacaggaagaggggggcagccttggaatggggaactggtcagggtaggtggggactgtgagcaggtcagtcccgtctccagggtctcggtttccctggctgtgggataggtggattctccagccctgggaggtgcctgggaagagctaaggctgtggggaggaggcgggggcagcacggaggggcggagatgggggcggggccagagccgtgggagggggaggggccagaactgggcggggggaagggcggaactaagagggggccagccctgaggggcggagccagcgtgttggaggggtggggttctgaagcttgggcggggcgagagctgagagaagggcggggctaaggctgggggccgctgacagcagggcagcgggagacagaggagccagtgctgttgagggggcggggctctggggagtgggaggggccaaagctgcagcggaggaagggcggggctaaggctggggagcaaagcagcgggagggggcgggggcatggctgggggcggagccagagccgtggggaataggggcggagcctaggcgcgggttccccaccagaaaatggggctctggcctggctcgcggaccacgtagtagtctttgtcaagcggcagcagcttagctaggccgaagtcagcgatcttgacgtgtgcctcgctctccacgaggatgtttcgggcggccaggtcgcggtgcacgcagcggcgggagcccaggtactccatgccctgcgggcgggcggtgtgagcgtgcagagaggatcccaggataatccggcaggtaccccaagcgtgacctggcaccccaacccagaccccaactataaccctacccccgagccatcctccactgaagttctgatcctgagccctaagccaaccccaccactcccgagacctggaccccaaaccactcctcagccttcaccgcgacctccaagcagacccctgcccaggccgtgccagctgaatccccacaagtcccggggcgccccctcgcaccttgcagatctgcgaggaatagagaaggaggcggctggcatcgaggcgcgcgcggtgccgctgcaggaagtcgcgcaagcagccgctgggcaggtactccatgaccagccgcaggctctggcggcctggagaaggcaggatctgtcacagcagggcccagccctgctcgtccccccattcttcccccctttcacagtgggaccttgtgtccctctcgacctcagttttgctgactgtaatatgggaaccgcaacaatgacacattgctaatatctcttgagtactttctacaacatacattgatgtgtttatatatcacggccaggtgcagtggctcacgcctgtaatcccagcactttggaagcctcacttgaggtcaggagttcaagaccagcctggccaacatggtgaaaacccatctccactaaaaacacaaaaattagccgggtgtggtggcacgctcctgtaatcccagctactctggaggctgaggcaggagaatcacttgaacttggaaggcagaggttgcagtgagccgagattgagccactgcctccagcctgggtgacagagcgagactctgtctcaaaaaaacaaacaaacaacaacaacaacaaagtaaatatcacaatggcccatttttcagctggagaaactgaggctcagaaaagttaaggtttcacaactggtaaggggtagagtcaggattcaaacctgtaacccatgtgaatctggatcaataatcacgttcccagcctacctaaagtggcctggcaggagggtaagaatgtgcactttgaaaagcacccatacgtcttggttcactcatccgggagctggctcacccgggccatagctgacaccacgatacttgacaatgaaatcactgtgcagtgctttgaggatctgaatctcccgctgaaagtccctctgctggtctggcccgctgtgctgcagctgtttcacggccaccagggcacctgtattgtcgcctagcgggtcatagcggcacagctccacgctgccaaagttgccctgggggatagcgggactgatgtccaggcacctggatgctgccctgccctctccaacccaccctggccctgcccaccttaccttgcccagctgtgagatgtacttgaggtgtctctcctcgaagatcgtggggtcttggcaggcatagagctgggcaccattccacagcccatcacgaggtgccagggcaccaggtgtggggtctgagaggagctcatagtctggggtgggggcatgggcagtggtaagcagcgcctctcatcctgggccccactcctgagttgacttgctgtgcaacctccatctgcatattgaccctctctgtgcattatggcagggccattgcaagccaaagggtaccttgtggagactggaaaaaggtgtctcccactctgtcccaggcaaaggaagcctcctcgtgcagtgcacaccctgtgcaactccacatggctacaaagatggaggacataatgagaactcatttccccagttccactgctatgaaatgtggccacatgactgagctcaggctgatggacaagatatgctgggtgcccctccagtcctgacccatggaaacctaatacggggccctccacactctctcttttatctgcagaggatccaacggggacccaacgcctgaggtgagtgcagccactaagtgagaggttcctgtgggcctggacaccctcattgaatgaagactaaatatcacactgggcatggttgtgtgtgcctgtaatcccagctatttgggagactaaggcaggaggattgcttgagccagtaattcaagaccagcctggggaacatagcaaaaccccatcacagaaaaaaaaaaaaaaaaaaaaaaaatccagcctggtgtggtggctcatgcctgtaatcccagcactgggtggctgaggtggacggatctctttgagaccaggagttcaagactagcccggccaacatggcaaaaccctgtctttactaaaaaatacaaaaatttagccgtgtttggtggcacgcccttgtaatcctagctacttgggagtctgaggcgggagaattgcttgaaccagggaggcagaggttgcagtgagccaggatcacgccactgcactccagcctaggtgacagagggagatagtgtctcaaaaatataaaataaaataaaataaaaatgcatacaggcatgcatcaccatgcctggctaattttctgtttgtttgtttgtagagatggagttttgccatgttgcccaggctggtcttgaactcctgggctcaagcgatccacctacctatagctggaactataggcatgagccactgcgcccagccaaacatttttttaaaagaatgaaatagaccagacatggtggctcacacctgaaatcccagcactttaggaggtagaggtgggcggatcacctgaggtcaagagttcgagaccagcctagccaatatggtgaaaccccatatctgccaaaaatacaaaaattagctgggcgtggtggcacacactgtaatcccagctactcaggaggctgaggcaggagaatcgcttgaactagaggttcaaggaggtagaggttgcagtgagccgaaattgtgccactgcactccagcctaggcaacagagcaagactctgtctcaaaaataaataaataaataaaatatcatcatgttgaaccttgaactgaggggactgttcgttacagtagctgttgaagctcacactgactgtcacagtcaccaacccctccaacctcaccagacacacagggcgtggcctgctgcaaaccacgctccttccactgggcccaatatgacatcacagccctccccacccaacccgtcccagcgggcacctgaagagatgaggctattgaggtcacgaatgacggctcggaaggagggcctctggaccggctcataggccatgcactgttgaatcagcagggccagctctgtccacttgggggccggcagctgctgccggtcctcataaaattggagtttctgagggtgagaggagcagtcggtaatccccaacccaatagacccaccccaatctccccagactggatgtcagtctgcccttctgtcaaagtgggggttcggagaccgatgccgggtgaggggctctgaccttagcaggatccagggcactgatgggcatggtgacgccactaaacacttcccagaccgtggcgccgaagccccacttgtcagcttccaagctaagtgtctgcgcctcccggagacactcgggggccacccaggggatcctgtcggtgagcactgagggaatgaaagtgggatcagggatccacttccttgccctgctcagcccctccctcctccacctccaggaacttactctccaggcttaacacagcggggctgaccccagggtcactcagcttgatgaagggcgggctcccatcagccccctcccgagccaggagcaccttccgggcagagacattgccatggggcaggcctttgtcctcctaagggggccagacacaggaaaatgcccgggagggtttgatgaatgaagagtctgtttggcaaactcctatacatccttcaaaacccacttggtactgctcagacatgctccagcatcgtccctgactcctgacatcctgtcttgcccctctagttcaccccctacactgacctggctatgtccctccccttctcaaacaccaccccatcctgtgactccccagtgcctttgacacaaagtgaaagctcctcagcctggcattcaaggcccttgctcaagcttccaatgaacttcccttccacacttgcaccctggtctcctgccaacagaactgcctgataggccccaggggatgcaacacactatctagcctgcaggcctttgcctaggctgttccctcagcctgacattccttccttcctttcttctcttgatgaacttctactcaacttttaaggccctatctccaatgttccttcttctaggaagcctttcttcctgcccagcctcgtcattcaccacacgccctgacatccaagaatgacttgttctcttctagtgttctcacaacctgaacctaaaatgccctcccctcgaacccttaccaaactcctatgcatactacagagcccactcccaattcctcttccacccagagaaagccttccctgggaatggagggtggagcaggcagaggagcactcaccagatagttgagggcgtaggccagctgtttgaccacctgcagcttccagctggctggcaccaggtggccacgttttcgcagatacatgtctatggcccccaggtgtacaaattcctgcaccatggtgcctggttggcagcagggagaggcggggttgggagactgaactgcacttgtgttgaggaggttctgccaacaccctggctctcagggtctctcaaactctcatctctgtctgttccctcccctgctgcctctgttcatacagtactcacctctcctcccacctccatctctgaatgatttgcctggaatgcctggaaggtgttgagccctgtctgtatctgtatctcacttttttttttctcttttcttttgagacagagtcttactctgttgcccaggctggagtgcagtggtgcgatctcggcttactgcaacctctgcctcccgggttcaagtgattctcctgtctcagcctcctaagtagctggaactacaggcgcatgccaccacacccggctgattttgtatttttagtagagacggggtcttgccatgttggccagactggtcttgaactcctgatctcaggtgatccactcgcctcggcttttcaattacaggcatgagccaccacgcccagcctctgtatctcacttctaaccctttgcatattctgtgtcctctgcctagaacacccctcttcctttcctaatccacacttgtccttatctttccaggttagaatgcatctctgtcttcccacaagcattgcccaacccccaggctggcccagcagcctctctgaccatccacagtgctccgtgctgccctcctcacacctcatcacaccctgcctgtcacattctaggctctgtcccagctcctggcccatcctagactcccaaccaatgaaaccaaggctcagaaaggttacgtgacctgtacaaagctgcagagattagaaagccaggtttgtctgacttcaggtcattctggggctggatatgggtgagaacctggagccgctttccaaggagtgatgatggagagacataaataaagggtaatgaacacggctcccatccagggtggcccagtgtgttgctggggctgtcatatagcggctcagaacagaggtgggaagaacagcctagacttgggtgaggcaggggtggggtgggtgggtggggggctctcactgtctccagccatgcacacgccgtggagcagcacgagatgccggtacgacacttggctcatcaagctcgctgcttccaggaatgactggggaaggtgggaagggagagaagatgcgtgggtttcttccactccaataatcccaaattttgtgctcacagacctgccttaggggaacacctggccacaggtcacctttggccctggagtctgccattagtgcacacagcactaccatgattttctgatacgggacagaagttcccactatcatctatggttttttgttttgttttgttttgtttttgagacagagtctccctctgtcacccaggctggagtgcagtggcgcgatcttgactcactgcaacctccgcttcccagattcaagcaattctcctgcctcagcctcccgagtagctgggattacaggcatgcaccaccacgcccggctaattttgtatttttagtagagacggggtttctccatgttggtcaggctggtctcgaactcccgacctcagatgatctgcccgcctcagcctcccaaagtgctgggattacaggcgtgagccaccgcgcccggcctaaaatttttttgtcaagacgaggtctcgctatgttgcctaggctgttcttgaactcctggcttcaaaccatcctcctgcctcagcctcccaaagtgctgggatgacaggcatgagccaccacgcccaggtccctgtgtgtttttaaatttctctgcatccacgaccccctctccagccagccccgactccaaaagtctggtccacattgctctcacctccatgcagttcttgtgcttggcatccatgaccttcagcagcacctctgtctttcgggcctccccatccaccacctcatggcgacagccccggtaaatcttggtgaaggacccatggcccaggttctcatgctgaatggtgaggggacagcagaagaggccagtgagggggttcctgcaggatcccagcccaagcgagacatagctgctggccccattttacagatgggaaaaccgaggcaaggtaaaattatagcatatgcctgaggccacgcatctgagtctctggaccccagactgaggtatcgcctcatttcccagggcctcttacccactccaggctgtcagcagggatcttgtgaaatgtcatctgactcagctggtattgggattggggctgaaccaaggatgatgtgggtgggctgtgacctctctggaccacgatcaggttggacttttctatggggagaggatgagggagaaaaaccagaaatcagaggtgaaaagtccccaagggttagctaactcatgccttagtttgaggtaccctctagaagccgaccctgagatgaagacttcagggcacatggctttttgttgttgtttttgttttgttgttgctgctgctgttgagacggagtctcactctgtcatccaggctgggtgggcagtggtgcgatctcagctcactgcaacctccacctcccaggttcaagcgattttcctgcctcggcctcccgaatagctgggactacaggtgtgtgccaccgtgcccggctaatttttttttttttttttttttgagacagagtctcgctctgtcacccaggctggagtgcagtggtgtgatctcggctcactgcaacctctgcctcctgggttcaagtaattctcctgcctcagcctcccaagtagctgggactacaggagtgtgccagcacacccagctaatttttgtatttttagtagagatggagtttcaccatgttggccacgctggtctcaaactcctgacctcaggtgatccatctgcctcagcctcccgaagtgctggtattacagacgtgagccactgtgcctggctggcacatggtttatttgaaaggagatccagaaagcccccatagggatttgggatgagcgacaaggaaggaaggagccctgcagggggctttaatgagcaagtggcactgtggacaaccagggatcggttctaccagggattctgggagactcagaagaactcacatctcagaattgtcccatcagaggggtttgtccaggagtgaaattcacccagaggaagagctgagagctggagagagactaggtgcagatgacatggctcacatctagctgtgcctagatcaagccagacctaaaggttatatatctctaacttcctgagccaacaaatcaccttttcttccctaacccaccttgacctgcagtttctgccacttgccacccacacaggagctgtcacagacatagaaagccagggtcccagatcagccactcattccaggggaggaaggggctcacctttgggtctggggatacagcaggaagtgagggtcactgccaccccatctacgtgcagccccccatcccagcaggttgccaggagctctcgaagactgctgtggggtcggctgaggccaaccagaaggaaggttcctgtggggctgcgccggatgaggcagcccttataatcaggaccaagggggttctgcaaagaagagtggcccctgagtgggactgagcgacagacactctccttctcagtccttcttccttttttttctttttttttttttttttttggagacggagtctggctctgtcacccaggctggagtgcaatggcgtgaccttggctcactgcaacctccgcctcccaggttcaagcgattctcctgcctcagcctcccgagtagctgggactacagatgcccactaccacgcccagctaagttttatatttttagtagagacagggtttcaccattttggccaggatggtttcgatctcttgatctcttgatctgcctacctcagcctcccaaagtgctgggattacaggcgtaagccactgtgcccagcctcagtcctttctcctaaagcaccatgaactcattccagtctttagacctttgaatatgctgttctgttcaccgggggtgtcttttccctcctattcttcaggaaccaaatgctgactgatcttttaaatctcaattcaaacgtcacctcctccaggcagccctccactacccaccctagcagtagaccgacctggacacagacagtgaggaggaagctgtcaaagtcctgggggctgcggcggagaacataggagccaggacgtgagcccccagtcttgagcttgttgatggcaaagtccagactgtgggggaaggtgagagggaatggggaggagtcagagatagaagaagacagagagacctgggctcaaattcaggtacctctgtagccctgggatccttgccaggtgacaccctccccccatttataaaatcagccatgggccaggcgccgtggctcacgcctgtaatcccagcattttgggaggccgaggcaggtggatcacgaggtcaggagatcaacaccatcctggctaacaccgtgaaaccccgtcgctactgaaaatacaaaaaaatagccgggcgtggtggcgagcacctgtagtcccagctactcgggaggctgaggcaggagaatggcgtgaccctgggaagcagaggttgcattgagccgagatcgtgccactgcactccagcctgggcgacagagccagactccgtctcaaaaaaaaaaagaaaaaagaaaatcagccgtaagtcttggcctcttctgggagattgtttgtttgtttgtttgttttaatagagacagggtcttgcttggttgcccaggctggagtgcaatctcagctcactgcagcctccaactcctgggctcaagtgatcctcctgcctcagcctccggagtcgctgggactacaggtcaaccaccacacccagctatttttttttctttttttgtagagatggggtctctcctgttgcctagacttgtctccaactcctgagttcaaacaatcctcctgccttggcccctcaaagcgctgcgattgcaggtgtgccccactatgcctggcccttcctgggagattaaacaagaggctgtaggtgaaggtgggcgacttgtccatctccaggaaatggccctggggtcagagagagagagagtagtggtcgccctgtgaagcagaaggaatacttcagcttcactgagcgctgactgtgcggcaggtgtggtttgaaaacttgacccctgtccagggctcctggaaggtgaggacactgaggcatagagaaggggaggggccctgagtggccacagaggccgggaatgggggacaggtccttacgtgatggggccgtggcactgctcggccacttcctccagcagcctcggcggtgccacctccttgcagaagaagtgctgggagtccgtggtcagccggaagtagccgtccacgagcgccacgaacgacagagcctcgggcagccctgggaactcggcctcctgcgagggacaagcgtcagagcccagtgaaacccgagggtgccggtcccgccctcggggtaaggctgaaggggaggggaatcctgcacccactaaaatctggttgtctgtcctggtaacagtgaccaggcggtgctctccggccgggccaacgcgcggggcctgcttgatgctaatgtctacgatttctggaaagtcgcagaagggctggaggacctgggaaggagggggagtaccgaagtgggggcccagctggaccccgccaaaccacgcccatgaacccacccccaagccacaccatccactccctatccctttgccattcaacccttccaagccgcgccccctcctatcaactccaacctctcaacacctcccctacccatccccaaacatctcccacccgctctgccaatccccgcctccttctctctgccggaccccgccccttgatccctgccccgcttcgcagcctcccagctctcggagcctcactctgcctcttagtcttgcctcgttccagcgcccacccacccactcctcaacccctcccattttcattcccgggtcgctcagcccaacccttcactcagtttgcccctcccattcccgcagtctcctccctcactaagccccgcccctcattaagcctcgcccacttccccaagtctttcgttttggctccgccccacatcccctaccactctccggcccctccccgagccccgcccccacgttggccccgcccagcgggggagtccgccctcacctcctgttctccctgggtccaggcgatgccgccgtcaccagccacgcggagcagccccagcccgtcgtggccaccaagggccccagggaggcccacgtggaaggtctcggcggccccggctggatccagccgctccaggtccatgatgtacttggccatgagcgagtgccggtctgcctggcaggcggccacgcggcgcagggctctgcgcaccgtcctccgaatacgcctccgcgtcacgaagctcaggccctggatcaggtcgcgcaggcttgggggtaggcaggccttgtagctgcaggggttggaggggagggagccggccctcagcgtcgggaggggtccccgcggggacacacacaaacccaggctttagcccaggggctggggtgcggccctagttggggcaccaggcacacacagactctcattcagggtcaggtatgaggaccggacctcagagtaggggagggccattggcgcccacaggtcggacagggaccccacaggccttttagctgggggaggtcaggtgtctgtccagctggagcctgggggtggagagggctgggttcgtgggaggccctgggtcataggaacaccctgaaagcttgcaggagaactccatggtgggagcccggcaaagccccgatggagcccacgttgctcactcccaagcagaggccgtccccacagcctggtggctctcacctgacagtcttcagcagctctcccggccgctgggcctgctctcgcgccatccgggccaggtccaacacggccaggctgagacactcaccctgctccttgagactgaggcccacggggaggcgcccactcaccaggtcactgcggtgctggggggccgccacagggagcatcagctgaggccacccaacttcaagccctgttgttaacctgcagacccccccaatcctgggctgacccccacccctggactgccacagggagggtcagacgaggccccacctgattgcatgccagtcctcatgttgccccttggacccccaaccccctgggtcaaaccccaggcagaaccccacctgggcaaagaggtgctccaggactggcaggtcaaggatagcactggccaaatccttgcgtagcccgaagcggtggcacttctccagcccaaaccaattggggaagtaaaagctgtgaggagaggagagaaccctgggatgaaagtgcaacccagcctcagtaggagtgacattatggtgggggcgagggacagattctgcggaggcctcacagagcccagcttgtacctttaacttgctgtgtgaccttgggcaagtgacccaccctctctggtctgtttcctcatctgagaaatgggtagtgaccatacctccctggggcaggggtgtgggcacctcgaaatgcaaggagatgataaaattgtacaatccctgggggctggggggcacttcctaccgaatcctgtacagcaggacttgggtgctggcatcctccacggagaagatgtggctcggggggaaccagcaggacaggtcctccgtggccagagcaaagagggagtggtacacaggcaggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccgatgctgacttctgcaggcaactattccagcttccaatcttggccccacacagccccatccttccctctggcccgatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcagggagggcatggaaaggagtgctggaggccgggtgcggtggcttatgcctgtaatcacagcattttgggaggccgaggcgggaggatcacttgaggtcaggagtttgagacctgcctggccaacatggcgaaaccctgcctctaaaaagtgcaaaacttagccgggtgtggtggtgcgttcctgtaatcccagcaactcgggaggctgaggcaggacaatcacttgaacctgggaggcagaggttgcagtgagccaagattgtaccactgcactccagcctggacaacagagtcagactctgtctcaaaaaaaaaaaaaaaaagaaagaaagaaagaaagaaagaaggaaagcctccctgggatgggcccaggaggaaactggccccctgcttccagcccccaacacctcccacccgctcgctcacttgccctgagaaacctcagcactcagggccctcagctgggtggggccaggggtggggcttcgagtcccctgagaaaaattggggagaaaaaggaggtcactcaaattgacctgaatgaagaagatctgaagaaagtgttgggaaaaacaaacaaaaacctaagttccagcagggcgcagtggctcatgtctgtaatcccatcatttccggaggccaagaaggaaggatagcttgagaccaggagtttgttttatgttttttgcttttttgagacagagtctcgcgctgtcacccaggctggagtgcagtggcgcaatctcagctcactgcaacctccgcctcccaagttcaagagattctcgtgcctcagccaccccagtagctgggattacaggtgggcaccaccacgcccagctaattttcttgtatttttagtagagatggggtttcactgatctcaaactcctggcctcaagtgatcagcctgcctcagcctcccaaaatgctggattacatgtgtgagccaccgcgcctggccgagaccaggagtttgaaaccagactgggcaatatagtgagacctcctctcaaaaagaaaaaaaagccttgtaatcccagcactttgacaggccgaggcaggtggatcacttgaggctaggattttgagacctcatctctaaaaaattagcagggcatggtggcacacccccatagtcctagctacttgggaggctgagacaggaggatgccttcagctctgcaagttgaggctgcattgagctatgatcacaccactgcactccagcctgggcgacagagcaagaccttatctctagaaaaaaaacacaatacaaaaactatgatccaaaataatgccctgtggctggggtggggcggcattaatgagggtttttttgtttttgttttgagacagagtctagctctgtcatccaggctggagtgcagtggcacaatctcggcttactctgcatcctgggttcaagtgattctcctgcctcagcctcccaagtagctgggattacaggggcacgccaccatgcccggctaatttttgtatttttggtagagacggggtttcaccatgttggcgaggctggtctggaactcctgacctcgagtgatcctcctgcctcggactcccaaagtgctgggattaccggcgtgagaaactgcgcctggcctaatgaggtttaagacaatcagaggactaggacccctaggactcagctttcgcagctgtgaaatgggctgactccccagcatcctcattgaggtggtctgctgagcgcaatccaggcctaaagtgtcaactcaattaatgtgcattaatttgtatatttcttgatgatgtgccggtaagcgatcaacaaacgcctgttaaaccaaacaggaagggcaattggcacagcggtgtggtggttactgtgggaagggaagtcttgtgggggaaagaaccttaccaaagggacactttgatgtcaccgatgcccagaccaagaatgagcacattcctagtcccgggaaccttggaggagccccatctctcccacagagagattgatgtctagttttgccctttatagaaataaaatcacacaccatagcctctctatcgtcccctcaacatcagccaatcaagttttttggtttgtttgtttgtttttttgagacggagtctcgcactgtcacccaggctggagtgcagtcgcacgatcttggctcactgtagcctctgcctcctgggttcaagcgattctcatgcctcagcttcccaagtggctgggattacaggcgcgcaccacagcgcccagctaatttttgtatttttagtagagacggagtttcaccatgttggccaggctggtctcaaactcctggcctcaggtgattcgcctgccttggcctcccaaagtgctgtgattacacacgtgagccacattgcccagcctttttatttatttatttattttgtaggggggaggacggattcttgttctgtctcccaggctggagtgcagtggcatgatctcggctcactgcaaactccacctcccaggttcaagcgattctcctgcctcagcctcctgagtagctggaattacaggcacccgccaccaaacctggctaatttttgtgtttttagtagagatagggtttcaccatgttgaccaggctgatctcgaactcctgacctccagtgatccgctggcctcagcctcccaaagtgttgggattaaaggcatgagccactgtgcccagccccagtcgagtttaaaataaggcttcagtggcagtggcgccccactgcaatcccagctactcagggggctgaggcagcaggatagcttgaggccaggggttagagacctgcctgaacaacatagcaagactcccatctccaaaacaacaaaaaaatcttaacagaatattattattctgtaatactgtaacaaaaaaaaatgaaaagtcagaggtgatgtttggtcccagaaaacgccatagtttttttggttttttaaaaatgtttgtagaaatggaggtctggctatgttgcccaggctggccttgaactcctggcctcaagctatcctcccgcctcggcatcccctgtttataatcctcaacgttctgcatcctggtatggtcgggtaccctgtgtctggaccgggaaggcctggagggtaggggctgggaactccgccccccaatccctccttcccaatccctcctccccacccccaaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgagaggaaagtcccactcggctccttcctgtgtgggccccttggtttcctgagccactgtcatttaccgaaagtcagggccctgcgggagctgggggcggggaggcgggcaaggaggggcagaaagttccggaagcctctgcatcagccgccccgttcagacaggctgctggagacccctaagccaaaggaactgatgatagcacagagaagggtctgggtcacaccaggggctcagccgactctagacccacttgttaagtggggctctggcccggcccttattgcctcagtttacccatctgtagcatgtgtgagttgggcacccagtggaactaattttgcacccagggaaggaaacctggctggatttgcccaggagggaagcagggaagttgccccagaggaaggtcaagttcttctttgaggtatttctcccttaagactcagggagacgctgggcgcagtggctcacgcctgtcatcccagcactttgggagactgaggcgggcgattacttgaggtcaggagtttgagaccagcctagccaacatggcgaaactccgtctctactaaaaatacaaaaattagccaggcgtggtggcctgtaatcgcagcactttgggaggctgaggcgggcggatcacttgaagtcaggagtttgagaccagcctggccaacatgatgaaaccctgtctctactaaaaacaggaaaattagccaggcctggtgatgcctgtaatcctagctactcaggaggctgaggtgggaggattgcttgaatctaggaggcggatgttacagtgagacgagatggcgccactgcactccagcctggcaacagagcgggacttcgtttaaaaaaaaaagaaaagactcagggagagataatgacccatttctgcctgtggtgccctgggcccagccctaaaaaaccaggtggatccggcctggcctcttggaacttgtgatctggcgctgagacaatgagcaaatgaaggagccaaatcatcgcagacaacaaagaaagccagggtgtcaggacaggcacagactggaacttggacccgaggcaggacagggagctggccagggaaagggtgctccaggaggagggcacaggatgggcaaagaccttgagagggcagtgatcttagcagcttgaagagcagtcaggaggccaggggcaggggtgagatgagggggaaggggactgcagggcggtcaacaggggcaagatcgtggggggacagggggatcagggtctttgggagaagggtgggttttgcctggagcataatctggagccacaggagagttggaagtaggagctgttataaatagaagaggcagaaggcccgggcagcatccaaatgcagagacttgggccagtgttcttaggataataggatcagagccccggaagtagagcttcaggaatagactgacgaagtggtgaccgggtacagtggctcacatctgtaattccagcactttggaaggcccaggtgggaagattgcttgagcctaggagttcgagaccagcctggccaacatggtgaaaccccatctctactaaaaatataaaaattagctgggcgtggtggcatgtgcctgtaatcccagctacttgggaggctgaggcaggagaatcactggaacccaggaggcaggcggaggttgtagtgagctgagattgtgccaccgcactccagcctgggcgacggagcaatactctgtctcaaaaaaaaaaaaaggaatagatttaagaagttgtggccaagaacagtggctcacacctgtaatctcagcactttgggaggctcaggcaggaggatggcttgagcccaggtgttcgagaccagcctgggcaacatggtgaaaccctgtctctacaaaaaatacaacaacaacaaaataataagctggatgtggtggcatgtgcctgtagtcccagctactaggggaggctgaggtgggaggatcacctgagcccaggaagttgaggctgcagttagctgtggtcatgccactgcactccagcctgggcaatgggagtgagatcccgtctcaaaaaaaaaaaaaaaaagacttttcatctctgtatcaccatcacaagtcttaacacaaaatggtttggtaagtattttgttgatcttaactgttcaatcagccagaggcttattggacacagcctgtgtgcagggaatcggggacaatgcagacccaatccctgtccaggggagctgacagtccagcaggggagatggcaataaacaagctattgcccaataattatatcagttgcccctgggaccggtctgctaagagagatgactggatctgggagggcttcctggaggaggtggctttgattctgaaatccaacaacaagtgggactagccagagagtgacctgagaatgtgggagtgtgggcagttctggcaggcagaacagcccaggcaaaggcctggaggcttcacgaattcacagtgttcctgagaagagcaggatgtcagggacacggggggctgagactcatttgatggcgtgggtagggccgcgtgggtcaagggaaagagatatagattatgtcctcagcttagtggagcttagtggagccacagctgacctgcggcaggaagtgccaagcagaagcttagttgtagtgttttctttcacttcctgggtggcttcagcagacgggaatgcaaccttatgttctcatccttggcctgaggctgaagcctctgctttccggaagtacagtgagtttctgggtctctgctacctccagtgtgatggtttctgcaatattttgagaataagtaagaggagattggggtgaggaccaaagtggtaccttcagccccagagaagggcatgtgaaggctctaaaaggaagttctggccgggcgcggtggctcacgcctataatcccagcactttgggaggccgaggcgggcggatcgcctgaggttaggagttcgagaccggccttgccaacctggtgaaaccccatctctactaaaaatacaaaacgcagctgggtgtggtggcgggcgcctgcagtcccagctactcaggaggctgaggcaagagaatcacttgaacctgggaggcggaggttgcagtgagccgagatcgcacaactgcactccagcctgggcgacacagcaagactccgtatcaaaaaataaataaataaataaataattttttttaaaaaaaggaagttctggggacagaacccagaacttgcccgagaaaaatggggcacgtcagtgatgcaaacacccagatttttctgctgacaagaagtccataaatacaatcaaagaataaaatacaatcaaagtgtaactggaaacaaaattgaactcatggataaaatatcctcgttatataagtaacatctagaaagcagtaagaaaatgccaaccagttaggtggatatgaatccagaagtcagagaaaatggaggacaaatagctcttaaacccagaaaaatttcctcagcttcacttgccaaatgaaaattaagagtacagtgaggcagggccaggcacggtggctcatgcctgtaatctgagcactttgggaagtcaacatgggaggatcatttgagctcaggagttggagattagcctgggcaacatggtgagatccgtctctacaaaacatacaaaaattagccaggcatggtggtgtgcacctgtagtctcagctacttggaagactgaagtgggaggatggcttgagtccaggaggcagaggttgcagggagccaagatagtgccactgtactccagcctgggcgacagagcgagactacatctcaaaaacaaaaacaaaaatggtaaaagactgaataacttcctcctgagattggaaacaagacaaggatgtccattttcaccacctctattcaacattgttctggtgatgttagccactgtaataagaaaagaaaaagcaggctgaggcaggagaatggtgtgaaccagggaggcggagcttgcagtgagccaagatcgggccactgcactccagcctgggtgacagagtgagactccgtctaaaaaaaaaaaaaaagaaagaaagaaaagaaaagctgggcatggtggctcacgcctgtaatcccagcactttgggaggctgaggtgggagaatcacaaggtcaggagttcaagaccagcctgatcaacatggtgaaaccccatctctactaaaaatacaaaaattagccaggcatggtaaaaatacaaaaattagccgtgcgtggtgatgcgcgcctgtaatcccagctactcaggaggctgaggcaggagaatcgcttgaacccgggaggtgaaggttgcagtgagccaagatcgcgccactgcactccagcctaggtgacagagggagactctgtctcaaaaaaaaaaaaaaaattaaaaattggcagggtgtgatagctcacacctgttgtcccagctatttgggaggctgaggattgcttgagtcagggaggacaaggctgcagtaagccatcatcacaccattacactccagtctgggcaacagagcgagatcctgtcttaaaacaaaaaaatatatgagaaaaataaacaagtcaggtgtggctgggcatggtgatacatgcttgtagcctcagctactggagaagctgaaatgggagcccaagaatttaaaggcaacatagcaagattctgtaacaagcaaaacagaataaaataagtaataaaaaaaaggtaaataaaactgttgctatttgctgatgatatgattgtttatgtcaaaaacccaagggaatctataagacaactactgaaattaatacataaattcagcaagttaccaggtttaaaaagtccgttgaattcaatacaaaagtcaattgaatttttatacaccagcagcaaacaattggaacataaaaaaattttgaaaaatttcctttgcagcagcactgaaaaagataaaatactgtgatggtctgagagtttgcgtctccccaaaattaatacattgaaatcctaacctcgaaggcggtggtattcagaatcggaaccttttaagaggtgattagatcatgagggttgagctctcatgaatgggattaatgcccttataaaagaggcccctaggctgggcatggtagctcacgcctgtaatcccagcaccctgggagaattgcaggctggtctctgacaaacaacttgtgtttgagaccagcctgggcaatgtggcgaaacaccacctctaccaaaaaaaacacaaaaattagctgggcatggtggtgcacacctgtagtcccaggtcaggagtttgaggccagcctgatcaacgtggagaaaccccatctccactgacaaaacaaaattagctggatgtggtggtgcatgcctgtaattccagctacttgggaggctgaggtgggagaatcgcttgaacccaggaggtggaggctgcggtaagccgagatcacaccattgcactccagcctaggcaacaagagcaaaactctgtctcaaaaaaaaaaaaaaaaaaaaaaaaggccgggtgcagtggctcatgcctgtaatcttagcacttcgggaggccaaggtgggtggatcacctcaggtcaggagttcaagaccagcctggccaacatggtaaaaccccgtctctgctaaaaatacaaaaattagctgggtgtggtggcgcacgcctgtaatctcagctactctggaggctgaggaaggagaatcgcttgaactcgggaggtggaggttgcagtgagctgagatcgcgccactgcattgcactcaaggttgcgtgacaggaaagaggctacatctcaaaaaaaaaaaaaaaaaaaaaagaaggccagggacctggagtccggagtgcatacaagtgggtggctttgcagtgttttgaggaccaacggtcagaaaccaagatttgggtgtcttgggcccagccttgggaaggcactggtgccagtaactgagatgagggaaagagtgggaaggatgaggcacatcagcattgtgaacgctccgtgatccaagctgtggcttggcccaggatcctggatgaacaaactggtgccttcaaagtccctgggaaaaagacaggggggacaggggtgcccttggacagccctgctaaccaggaactcctcgcctgggccccactggatggtgataacagagacacagagtagcccaggaccagcctgctcaggtcagattcctgcatggcccgaggtgggggcagaggaatcctgccaggccaggtgtgtcactaggaagccggggccacggcatcactcaggcaccgacaacatgtaaaagaaagaaaaataataaagcttttttttttcttttaaattaagacagtttcactctgttgcccaggctggagtgcagcggcatgatcttggttcactgcaacctctgcctctagggttcaagtgattctcgtgcctcagcctcccgagtagctgggattacaggtgtgtgtcactgcacccagctaatttttgtatttttggtagagacggggtttcaccatgttggccaggctggtctcgactcctgacctcaagtgacctgcccgcttcagcctcccaaagtgctggggttacagatatgagccactgtgcccaaccaaaaagaaaaataataaagctctgggccgggcgcggtggctcacgcctgtaatcccagcattttgggaggctgaggtgggtggattatctgaggtcaggagttcaagaccagcctgtccaacatggtgaaaccccgtctctactaaaattacaaaaattagccgggcgtggaggcagatgcctgtaatcccagctactcaggaggctgaggcaggagaggatggcttgaacccaggaggcagaggctgcagtgagctgagattgtgccactgcattccagccttggcaatggagtgagactccgtctcaaaaaaaaaaaaaaaaaggaaacaagaaaccctgtctctacaaaaattagccaggcatgatgatgggtgcctgtaatcccagctactctggagggtgaggcaggagaatcgcttgaacctgggaggcagaggctacggtgagatgagatcacgccattgcattccagcctggggaacagagtgagactccatctcaaaaaaaaaaagaaactaaagaaaaataataaagctttgaaacaaacagcacatcacgacccgtgcccttccccaccctggcatgcccctccctccactccaacccaggccttgaaggcagaagcacgaggccccaaggccagggctgggtctcagggatctccctctcgtcttcttcctcctcccctgtcctccctaaattccttttcctgccccgttcctgctgtcccaggatccaatttgtgctccaggctgcgctctgccctttccagcatctctttccacctgcttgtagccgctcagcactttggggaaactgaggccagagcggtgagttccagcacagagggaagggcagggcctcaaccttcccagtccaaacaatcatacgccatttaaatctcacaacaaccctaaaagctggcgactattattggcctcattttgtggaaggggaaactgaggcccagagcggcaacgcggccagcgaaccatcggtaagatttgaacctggttgtgtatcattcaacggtctagcgcttggcctcagctgggccaccgcagatgggacatggttctgctgccacctggtggacactcgcggcagcgctgttgggatagagccgcctctcacctgacgtcctgccccgaaaagcccagccagaggagggctgacctgctcccctggcctccctgccccgcatcacgcccatcagttttccgaattttcacagtctaagtgtccaccaggaagggactgggtaactaaccacctgtgctacagttgggctaaagattttagtgcaaaagttaatttgcccacctcacaagaaatactaaaaaaatgtatattttttcgagacagagtctcactctgttgcccaggctggagtacagtggcacaatctcggctcactgcaacctccgactcccaggctcaagcgattctcatgcctcagcctctcaagtagctgggactacaggcacccgccacaatacccagctaatttttgtattttttaatagaagcggggtttcaccatgttggccaggctggtctcgagctcctgacctcaggtgatccacccacctgggcctcgcaaggtgctgggattacaggcgagagccaccgtacccacccaaaataaattctttaggctgaaaacaagggaccccagacatgtattccaatccacgtgaaaatctgaagaacacatataaaggtaatgtatgtaattttaaaagattgcataaggccgggtgctttggctcacgcctgtaatcccaacacttcaggaggctgaggtgggcagatcaattgagcctaggagttcaagaccagcctgggcaacacagagagaccttgtctctacaaaaaatacaaaacttggccgggcacggtggctcacacctgtaatcccagcactttgggaggccgaggcgggtggatcacgaggtcaggagtttaaggaaaaaaatataaaacttagctgggtttcatggcatccgtcctaactactcgggaggtctgaggtgggagaatctcttgaacctgggagttcgaggctgcagtgaacagagatctcgccactgcactccagcctgggcaacagagtgagatcctgtatcaaaaaaataaggctgggcacaatggctcacgcccatgatcccagcactttgggaggccgaggcaggcagatcacgaggtcaggagattgagaccatcgtggctaacatggtgaaaccccatctctactaaaaatacaaaaaattagccgggcatggtggcgggcacctgtagtcccagctactcgagggggctgaggcaggagaatggcatgaacccgggaggcggagattgcagtgaactgagatcacgccactgcactccagcctgggtgacagagtgagactccgtctcaaaaaataataataataaataaataaaaataagatctgccagtgacagtggctcatgcctgttatcccagcatgttcggaggccatgacgggcagaccacttgaggtcaggagttcaagaccagccatagccaacatggcgaaactcttgtctctactaaaaattaaaaaaaaaattagccaggcatggtgccgcacatctgcaatttcagctacttgggaggctgaggcaggagaatcatttgaacctgggaggcagaggttgcaatgagccaagattgcaccactgccctccagcctgggtaatggagtgagaccctgtctcaaaataaataaataaaaataaaatgtagcataaatgcaaatttcttctctctttgcctcttaacatatttaaaaagcaattgtacaaaactatatattggccgggcccggtggctcatgcctgcaatcccagcactttgggaggctgaggtgggcatatcacctgaggttgggagttcgagaccagtctggccaacatggtgaaaccccctctctactaaaaatacaaaacattagccgggtgtggtggtgcacgcctgtaatctcagctactcaggaggctgaagcaggagaattgctcgaacctgggaggtggaggttgcagtgagccgagatcatgccactgcaatctagcctgggtgacagagcgagactctgtctcaaaaaaacaaaaaacaaacaaaaaaacaggctgggtgcggtggctcatgcctgtaatcccagcactttgggaggccgaggcgggtgggtcacctgaggtcaggaatctgagaccagcctggccaacccagtaaaaccctatctctactaaaaatacaaaaaattagccaggcgtggtggtgcacgcctgtagtccca

SEQ ID NO: 1116 - DNA, 31472 bp, Homo sapiens
tgtgtatggaaaagtaaaatagagaagaaatacactgaaacattagtttaggttttagcttggattaaaggtgagtttttaaagtttttgtttgtttgtttgtttgtttgtttgttttattgagacagagtctcactctgtcaccaggctggagtgcagtggcgcaatctcagctcactgcaacctctgcttcctgggttcaagtgattcttgtgcctcagcctcccaagaagctgggactacaggtgccggccaccacagccagctaatttttgtatttttagtagagacagggtttcacaatgttttccaggatggtctccatctcctgaccttgtgatccgcccgcctcagcctcccaaagtgctggcattactgttgtgagccaccgtgcccggcctaaagttcttcttgatgcttctctgcattttctgaattgtcttcaataagcatccatatttaatcagaaaccacaaacatatcattcactaaatacacatcttcaatcatacagttctcagtatgggaacgcatgaaagttctgctttcactggcatatcactggctgttcatgccatgtggcaatacaccccgaactaccagatttggcactcccagccctaaccccacagtctcagacctcagcccactccctagtcctgtgtccccgtgaccaaacccacacacgcattctcctccagccaaactggtccccacatgtttccaaaccagccttctgttctgtgctcctcagcctaactctcaaatggttcagaaacacaaattcgcatgtgcacagagagagacagagacagagagaaaatccaaatatgataaaatactgatcatcattggtgaacctagatgaaggggaggcatgcttacaatttgcattgtagttggatattttcaaaataaaaagctggggaaataaaggagcagtgtagtatagtatttaagggcataaattctgcatgaaattaccttatttcaagttccagtcccactgcctattagttgggaagtagtaacattaggcaaggtacttactttctaagactcagattcttcatcagtaaaatggggataatgaaaatcctggtgtatttgtttcctacagttgcccagagaatggaatgtatgtgtgtaaagggcttggcgaagagtgccacacacccttgatcatgaactgttagtatcagtgctaaatatagaaatcaatttattaaccgtgactctattcatgatattctctacctccataagctgctcatccctggacaactaagtaaagtgctacagctttggaaacttttcttgcacggttctttttctgccactagccctggaagctgctccaatgcggtgcctgccccgctggtatccatacctccaggccctggcacagagcctggcaagggggaagaagccattaaatgcactgaaccccaaatgagaatctcaaagggttcaagctgtactttaaagaaaactcttctcatcaggaccaagtttgcacttttgctgatgcagccactctattcccatgggcttccttgagataaggcatcaccttgataaattagctgtagatataggcgtcttgcagttggcatgggaaagcaatttaatttccaattaagcctgatttctgggccaggaggttggcctacctcgcactggaaggattattctggccaggcctattattatcacgggtcatgattctcccatgaagtggactctcaaggaagctggtccttcaaccattggaatggttcagtgaggcagaaatacggcctctgtgggtaggaccctttttccccaggaattaagtttatacaagtagagtcagggaagttcaaagcaaagataggcagtctgtttgtggccaaaattgttaagtcagggtacccctagaaatgaagcaagaggggagagagagagggaggtgaggcagtcatcaatcaggcccacaagcaagagaggcgggaagttgctagtaagaaaaagacggcaggaggtagttctctgagcccaaatcgaaaagaatctgaattatcggttgaaggagacacacttacttgaagagagaacagacatttgtgaagcatcttttatgcaccgtgctgagtacttcacattcatgattgatgatacaatgcaccctgtaaaacaaacactgtgaggctcactttccaattgaggaaactgagattcaggaagattaaataaactgcccaaagtcatgaacaaggcagattcaaactcttgttttcctgagcttttctccctgcaggctccctctcaaagacaaatacaaaaacatcatttagggccataaggataatgccatactcagctgtatcttacccaccaaaattgtaagcatgagaaaaaggcctttcaaacaagtcctgagagagtgaaaataaatggtggctgaggctgcttggggcgaatgatctgatggaagagctaacaatatctacttctcttttgggtgttgtttttgctcccatctgtccctcaaggagggagacctgagacctgggcgcaatggcccagcatggctgagaggctcctgtgaggtcaggatctcctcccacagctcagactgcttcaaaccagcggggttctggcttgtggctgaggggatttcaattcagaagggttggaaagaaacaacagaggggaatgagggatcatgaccagtggagccacagaaaatttagttaggtgccaagaaggtatgacatggcctaagtttagttaacgatagtaaaagaggactctgaggcaatatgtaagcaagcatgctgtcaactcctggacaaattctagagcgcatgattaaacccatggtttgggaacacttgtgaaagaaagtagagatgaatgagaggcgggtgcatttgctgagaaggagctgtgccggtgtaccagtctcccttctgttctgcttttgcatagtgaccagttcaaggatcgctgcaaccatggtgtgcctgggttccagttgggcgtgtgatgagctatgggctggaaagcatagatttaggcaggtgccagctggcctcgtggtcctgtctgtcttggcagtgcccacagcagaacctttgtgggacattttcagatccttctgcttggccatcacccccacatctattgagacttcagaggtgtggccccagggagtcaattgagagcctgggctctgtgatggaaaggtatctggaagcatctaacaagctctcaatagttgaccttgacctgcttggcattttccacttttgatatggggtaaagacaagaacaggattcccagtggttagagtgttttctggagcaataccacctagatttgaattccagctctgctatttgctaacttctgccttggggcaagttaaatcttttccttgtgcctccattggctcattggtgaaatggagatactaataataacctcaaaggatgttgttactgttcaatgagctgtgcctggaaagatcctggcattcaggtaggtgttcaacaaatgctagcccttattaccgttaggaatgatagattcttgcacagcaagtgatcagctaaatatatgcccaaatgaaagtggctccatcttgctatagtgagttattcatccaaagaggtgttgctgcaggttgtcattgaagagaactattgtagaaagagtgtgactgtgttctccccgacaatacttctgacaccacgtaagagggttttcttcccccctactgataccaactagtttggacaccaactgggtgtcctacaatttaattcaattctgacactaactacccagagttagctcagaccccacaggttaagaactcagtcccacaagactgcccccattcaaatgccagccaccaatagggtgtcctgactatccacacttccacctgactgacagaacattcctacaacctcccctacacctccagataggatataataatttactagagtgatccacagaactcaaaagaacattttacttactattgacacttactattacatgttgattacagaggatataactcagaaacaggcagacggaagagacacacagggcaaggtatgagggatgcagggtggaggtgcagagtttccgggccctctcccagcaccttgacgtgttcaccaacccagaagccccccaaaccctattatttagggggttttatgaagatttcactacataggcatgattgttaaaccactggccattggtgattaaactcaacctccagcccctcttccctctgcagaggttgccgggtagagctgaaggttctaactctctaatcatggcttggtccttctggcaagcagctcccatgccgaagctatttacaggcccaccaagagttatctcactggaaaaaagacactcctatcgcccctaaaggacctctgtaccaaagaccaaatatctttctgtgagacaacagagagttcaagcaccaaatataaagtggagaagcactagatgatctctaaagtcttactggcacttggagaacaagtgtttgtatttgaacatgcggaatcaaaggggagttgagtaaaaggggctccagaattgacacaggaggaggactcagtgcagcaatctcatggggcgtggggacagaagacacatcccaaagcttcatgtgcctctcaagcccctgcttttgttttatgtgtactggggataggggaggttggtatggaatgatggagattatgggagaacagagtccatctaagccacttttgactctgcaactgggggagatgcagctggcctgggaaggaatcacaaacgtggtccagtactcagtttagagttgttggctttgcttccatatacctccctttctcatctcccaaatcctttgaggaagttggctggtgaaaatgtacttatgtaagtggggagggagagttgtgcaaagctaggaagaagctgagttctgcatcagaggtgacatgagaaagaaccaggaaagcactgtggagaggaggatgacccatcaactgactcatctgggggacaggatctgggagccagaggtgatggagaaaactaaagccctcctcctggcccccagtgggaatctgatggagcctggtggagagcctcacatttctacagggcacggtgtgggaggggcctggaggccttgtctctggatgcactaggctggcagttctgaagcttttcatcatcaggacccttttacatgcttaaaaaatattaaggatcctaagagctttggtgtatatgggttatatctattaacagttaccattttagagattagaactaagaatggtaaaaatatttaatttgaatttacttattttaaaataataatacatccattagttgctaacaaaaataacatatttttttgaaaaacaattatgcgtggcaaaaagtatattgggagaagtggtattgttttacatttttcacaaatctctaatgtccagctttagaaaggcacctagaatctcattgctacctcggcattcagactgttttaacaatgcatgttacatgacctctggaacattccattgcactctcataagagaatgaaaatgaaaaaggcaaataatgtcttagtattattatgaacagagttttgactttgcaagcctccactttgagaactgctacactggactgtagtgaatttctccatgtctctctgatctttctttggtcattttctttcccttccatgtgacagggcaatggctggtgaggtacaggaaggtggcactttgctcaaacagtgtcttcttaaatatttcatagaattcaaactcccccaaacacaagaccaattcaaagaatactggatattctcacataacagcctgtgctgccaatgaacaataaaataaatgcagtttgcaatgccctgacccaaggagtttaagataaattttggatgagttgttgatttagaggaggagctggtatcacttcagtaagtcacagaaaataagattatattaatatttatattgcattattttaaatctgcataatgctgagtcttcactgtgaagaaggaagcccctcacaatgattagtgaggggtagggagggagaatggcaagaagacaccaagttccttgcaggcaagcaaatagatacatcataaaagtgaagtgaaattccagtcctctgagatcttcataaatagaagaaaccctcatttctttcctcctctggttgcagcttggactgatgagctgaagctctgtctgagacctggcactgttaggatgtcccccagggttctttccaccccagttctggagctcaggtggccccttgcctctgaattccaccgctttgtctgagttctggaggacggcacatgggagaaccatccaggtgcacctctccaggtatgagtcactagtccatgagaggacaataataaatgatggaagcactagacactcattagcagagtggtttattaagaactgatgaaggttctctgctcccaggcagatattattgcaaaaaaacacgtaggcacagggtctaactccatcatgcctaaattcccattatttcatgcttatcccgtgcataaagttctgtgagcagcagacagttgtggcatttgctagaaggccagtctttattgacaggaggagaacatctatctcaagcaaatgaaggtcatcattaataatttatgggacagtgggggttaggcatcctcacatactaatttttctagaggaacatggccttttcccctgcagggattgtttgggtattctgagtttctgtgtattttagtcccaaattcaggtgcatggaaaccattgacaaaatagaccctttaaatcagactccaagttgggacttcctttcttatttttcttccttttttaacttaaatttttgagataattgtagattcacatgaagctttacgaaataatacagagacattccgtgccccctctacctaatgtccccaatggtaatatttaatattttgcaaaactatagtacaatattacaattaagactttcttaaaagactcacatgaggacctttgagacttccctgaccccagaaggaaaaaattccagggaatgatgagctgcctgcctttggaaggaaggtccaccaggtaagaaactggaggccacagggatacctctgggctccctggctggaattggcagatgctggtgcagatgccagggcctcccctcagaactccaacctgcatgagggcacctgggttccagggatgcaacgcagctccctgcctggcccctgtggctttgagtggctgtgtccctcagcccttcacagctggctctgcccctcagcccttcacagctggctctgcccctcagcccttcacagctggctctgtccctcagcccttcacagctggctctgctgagttctgtggttgagatgccaggtactggaacacacagctccaggcttgagtcctagcccctcactttacagatggccttggccagttacctcttacagcctcagtttttcatagtaacttagatagcacttaccatatgtcactatcctaggaaatttacataaaaatttgtttcatgccaaaactctatggaaagatactattatcagtttcgttttgcaaacgaggaaacaggcacagaaaggttattcgtccaaagtcacccagcttgtgaacagcacagctggaatttgaacccaaacagtgcacatcccaagtccacatacttagccactgtcctctgttgcttctcatcatctgtgaggcaggttcaggagtatctcatttttttttccaaggcaaactaattagtacagtgcctggcacagaataaataagcacccatacatgccagataacattgtcagtataacttctggaagtttctgagtattcatgacttattcttttttttttttttttttttttttttttgagacagagtcttgctctgttacccaggctggagtgccgtggcgcgatctcggctcactgcaagctccgcctcccgggttcacgccattcttctgcctcagcctcctgagcagctgggactacaggcggctaccaccacgcccggctatgattttttctattttttagtagagacagggtttcaccgtgttagccaggatggtctcgatctcctgacctcgtgatctgcccacctcggcctcccaaagtgctgggattacaggtgtgagccaccacgcccggccgactttttcttgttactaacaatagctctttttccctgatcctctccctcctcctacctcccgccctccaataggcctcagtgtgtgttgttcccctctttgtgtccatgtgttttcatcatttagctcccacttataagtgagaatatacagtatttagttttgtgtccctgtgttagtttgctaaggataatatttggcctccagctccatccatgtccctgcaaaggacatgatctccttcctttttatggctgcataatattccatgacgtatacgtaccacattttctttaataatgggtactagacttaatacctgggtgatgaaataatctgcacaacaaactcccttgacacaagtgtacctatgtaacaaacctgaacgtgtaccctgcaacttaaaatgaaagttaagaaaaaaacacacacacaaaacaaacaaaaaaaactatagttgccattttaaacacctatgatgtgtcaaacattccttcagccctcccaactatccagaaagagtccttcttttatagatgaaaaaactaagaatcaaagagatgaaatcgggcagagtagagacaggattcaaacccaagatctgcatcttggactcacaacactggaagaaacttcagacaccagcctaacttcacacccagctcaggactggccctgccgaatggtcactcacctgctctgaaaatcctcgcgacaggacgctcacttcctacaccggtagttctctggctcgaggtgtgccacagaatcccctacgcattgttagaacacagaacattgctacccccaccccgtgcagggcttctggcgtggtggggctgggacaggggcctgagagtgtgcatttctcacaagctgccacaggatcctgatgctgctggcccagggaccacacttggacagtcatcgttctaggaaaacttcctggagtgggaatggtaaaggtgatggcttcttcccattttgcccttttcaaatctgagataggcttccccagcaggctcagtgccagagtccataccctcaatttaaataacaaatcctcctctatatcatgacctttcctccagagggttgtttttcattttttgttttttgttttttttttgagacggagtcttgttctatcaccaggctggagtgcagtggcacaatctcggctcactgcaagctccgaaccccgggttcacgccattctcctgcctcagcctcctgagtagctgggaccacaggtgcccaccaccacgcctggctaattttttgtatttttagtagagacggggtttcaccatgttagccaggatggtcttgatctcctgacctcgtgatccaccagcctcggcctcccaaagtgctgggattacaggagtgagccaccgcgcccggcccagaggggtttttaagattgtgtgttctgaatggcctgtctctgactggaacccaactccgtccccagacccacttccatctttttctgtgagggggacacactctttcaacttttccaaaatggcatctaccatggcttttctgattaaaagcaaacgaaacacacccttcctataatcaaaaatttagaaaagcagcaaaaataaaaaggggataaggaagaaaacagaaattaaccaccatcccaccgctaaaattttgatgagttctcatgtgtttccttgcagctgattgttgtttggcatacatttattaatattggaattaaaaatatatatggcactttatatcctagaaaatagtaatactgtaaatgtgttctagaaatgggagctgctgttgctcttattagagaattcaaacaaagaagggaggctcgctggggacagcttctgggggaggatgggtaccgctttgagacaacagggagaactcaggcacagaggtgacgatcatcgttctctgtggggcacatagtgatgcagccggaaacaggtatgagtcagttgagtggggacaggtaatagagagctagaactggctggccttatggcctccaaggcattggggagccactgtacattcttgagcaggcaatgacttcacaaaaggatttctcaaaggttagtcctgcaacagaagacagcgtggattggactggaagagtgggagggcaggtggagaaggcattgtgctgcaagtggggagcagccctgggggcccagccagtcccctgtgccctgacaagtggtatggcatggatggatggctctacttctgggccgccaggatggacaggtactggttgctcttcaccatggcgataatgaggaggccaccggtcagcaggaaggtgggccagaagagggagaagaggagggcctggggcccgtagaggcgctggaataggacgctggtttcgttcccccgaggtgcggagaagcagtagaagacctgctgctcttggaatttggctctgaccttctccacgtcggcccgggccgtctggtaattgtccacgctgcctgggatgtaggagcactgtggggagaaacaagagcagctgtgggcttggaaatccccatttcttagccaagggcttgatatggagtaaagaaaaataccagctttgtagtcgggcccctggattggagtcggggctttggtctaaagcttggcaggccatgcgctgtacaggtctggagagcacgctctcatttgtgtcttgtgtgtggatggcggtgctggagctgctcggggtacaggctacacacctgggcgcaggtcctaccttggagtcctggctctgcttggattggctgtagaatttttggcaaatttctcactctttctgagccctgaagcttcatcacttaaatgggtgaatatcggtttcaaaggatattatgaaagaaggacttcacacagagctatctaaggaaaccagggagggacacaggccaagtgggctgtgtatttgaaatcgagatcatgtgctcaattgcctacagggctcatgaaggtattgtcagagggtgaagcaggcaaagcaatgagatgacaggtgcccactgactcttgccttggtgccaggaagaattgccagggtgtggcagggcctgtcaatagggagagagccagctgcctccagacaggcagtcaccactccctccaggcaatggatgtcaggccatccagaagatctataatagccagacctccaacactttaagagaagttagaaaccagatcacacctgtaatcctaacactttgggaagccgaaggggaaggatcccttgagcccaggagttcgagactagcctaggcaacatagcaagactttatctctacaaaaaaagttaaaaattatccaggtgggcatggtggtgtacctgtagtcccagctacacaggagactgaggtgggaggatcacctgagcccaggagttggaggctgcagtgagctatgatctcgcaactacactccaggtaaggcaacaaagcgagatcccatttcaaaaaaaaaaaaaaagtaaaatattagctaaatttaaaattgaaaacctttgcagtttcaacctgtgtacagcaaacaaactatgttggcaagcgggtatttgacactgggatccaaaggaaagaaagaatgcattgaaaagagttttgtgccagcagagcatgacacacatttaattctgacgttgattattgttattaggaactttctgccctgttcagatgaggccagctggaaagtgatgcaaagcagtcataaagcggagttttatctggttttatctctgttctgagctgcaagtgtggtgcccccatctgcagcagaatacctacagggcccccatagcccaggtccctacccactctgcatcactgagggcgagacccaggaatgtgtgattccttcatgcacttaattttgccctagtgaaatcatgtgcaagatcaaaatgtgtaaaactgagacccaaatggcaggtgttgagccagattccttgcaggcctcggccactccctggatttatatgaggtgccaccctggaagctgcctgccctgagggcattcactccagcaacacagaggagggttgcactgtagttctcacagcctgggaaatgcagatgctgcactcagatctagggccccagccagccagggagtagctgaggctggggagacgctggctcctcaggaatctggcattcagagctgttggacactgccaggtcctcagtagcatataatccagcatcctgagctgacggtgagggggcctggcctgagtctctccaatgcctctgactgtgaccttggctaacctagctccttaaatagcagtgtggctatggagtcagacaggcctgagttctgagctgtgtgaccttggcaactgccacaacctcactgggccttgtaaaatgggtttgtgaggctacctgcctaggagaactgtcatggggattaaatgagatgatgcatgtaaagcactgagcacagaagcccagcacacgataagaactcaaaaaagtggaagatgctattattaataataatatgttttgacttatctatgaaattgcaacaacagctccttctttaccttcttaaaaagaggtctatggatgagctctgaagtagaggcttctgtccatcctgggcctagtgtatcctctgcctgctcagggttcctctggatcttttatgctgggcctgtttggcaagacactgggcaggaattcactcttcatggccaaacccagaagccggggcctgaatgcatcctttctctcctgtcctgggtccagctaagcctgagttatctgaatgatctgaaaccaaccagctttttcccaagccctgcagtgtaaggtccccaggacagacaatgggagggaatttagaactcacctgctccaggctaagactcacaggaaaagctgagggcagactatggcccctaccttcagagttggagggtgggatgagagtcttcttggcccttcacagtgattccagaggacacccagctagcctggagccccagccacttgaacccctatgatggacataggcggaaggagcagctagcccacaacccagctgcttggcaaaaacacgaagggcatttccactgcttcctcccagctcctgcagcctgctatcagcaccacacctggtcaagcctgggcggcaggggagaggacagcagtggctccagcatgtccttccttcacatcctgctgacagttcattcaggggatgctcctctgagctggcaatctcaggaccagggaggcagcctgaaaaccagcctgctctggcccatatcactcccggagaatgttaccagttattgaaaatttgtttcttgcattgggataaatcaagggctactgaatgccaacgcagaggcaggggtcatgggtaggagctgcctccagtgggccctgagacctctctccaccgggtggggccgagtcatactagcgatgacagaacacctgaccatcctgcactgcccagacccacttctcattgaccttcagcactctcaagatcccccagcctccacgccccatcccaggcaccctgccccttcccgtcccatcagccatcaagtccggactgtcagcatctcccctgctgcaggccacatcttggtcgtgagtgcttgctgcggccttggctcctctgtctagtaactggacccacacacctgtaggctccatcttcccagcccaactctgaaactctgatcatgccctaaagattcccattgccaacagcaataatttccaaccttagaatcaccttgggagctccatgaatggatctctgaccagagattccaccttgatatgtctagtgttggaccctagttttgttttttaagactcttacagggttctaatgcatagccaaagttgacatatcttgagacatacacactcacattttaattccatattgtggtgatcaaaggcctctgggaacagaccttagtctgccctgacagccttttccagctgcatacaccccatcatgggtcattttctgtagtcagccctctgatccctgtctccacctagcccttccctccgccatgcctcgtcctataggcatacccgcttcctatatcacctcattctctatgccttgcatcctgcgcctgcctgatgttaaaagcctaatccaagagcctttcttttttttttttttttttttgagatggagtttcactcttgttgccaggctggagtgcaatggtgcaatctcaccaagagcctttctgatacccccatcattgtcagctggaaaacatccccctcctctaacccctgtaacttcctctgttcttctccccggtgccaattcttccctgctaggcactgttcatgcatgagctctctcctcttgagtcctacaggcttgacacaggaggtgctcaatggctgttgaataaataaatgagaggaggaaagaaggaaacaaggaaggaaggaaggaaggaaggaagggagggagagagggagggaaggagggaggggaaaaaaaagaaaagaaagaaggagggaagaaagggaaaaaagaaggaaagaaagaaggaaggaagagagacagaatatgggccaactgatcgctttaggaaaggatatggtggtgagttttgtgttttggagggggagggtgggatgttgggatgcaaggatggaaaaaccatctaaatgtttgtttatggaggttactccagccctgagtccctggtttcctggggagtcaccgggattccactttgaggatctggccctgggcctggtccctcatttgactgaggttgtagaatgaaagtactaacactaatcactgcttttgtttgagtgcccactatccactcagcatcaagcgtggcactttatatacagcgtctctgacttgataacagctcttcaaggtgcagcattagcattccactttacaagggtggaaactgaggaggtgagaggctaagtggcctgcctatgtttacacagccagttagcggcagattcaaacccaggtctgtgtgactccaacacagaagagctagggctggctcagtctcattccagctgtgagacctggtcaagtgggttgatctttctcagcctcggggacagggacagttaggaacaggctcacacacctgacagggataaagggatgtgtccccatccctccagttcagtacctgctggttctggtcccgagtgtcctccgtgtggtacagcacagcccacctgccggcagctgacacgttgacccacaggcatgggtactggggcaccttcttgcccttcagctcctcctggtccctgatgttggtctcaatcaggtggcacttggattcctgggtccacacgctgaggagaccacacacatgcacacatacacatctcagaactgggtgacacacagaacacccatttgaacccattatcccctgggagcctctagagggatccaggactgggatcctcatcttgtcttcagcatccagcaataaaggcacatgaccccacagtccccggacacagggaggaattgtagaagctggatggggtcttagacattatctatatgactggttctcaaccttggctactcttgcaacaacctggggagcttctaaaaagattcccgtgtccaagctacaccccagagcaagtgaatcagaacttcttgggtggtttggcccaggccctgggtgttttttcaaagctccctgatgtgattctgacgagcagccaaacctgagactttcttatccatatcgtcttcattttgcagaggcagaagagaaactcagaaaggtcaagtgactttgctgagaccttgcaggacctgaagctaggtctgagtgggttggagagctgtgttctttcccctaaaaggagcagatgtagaaggggtttgagttgagccaggatgggaaagatggtggggacagtctctagatggtgcttcaccagattaagagtccagcctggaatcgcttcagcgttgtgaagagtgaggctgcagcaggcccgggagaggctaacaggttcatcaacatattagtaaatcagttgtgcttcaactcccaagtatcctgtgggagacccattgccagtcagaagggggctgtcagctgctggaacgtgcccagagcacaggtctgagacttatcctaaggacaggctgggggaactgagtgtctttgttccaaatagaacacgaattaggaattcacagcttttccttaaaatctcaagtggttgatatgtcatggagcaagggcatggaccattctctgagattcctgagcagaacttcagggaagcagatgctggctcaatgcagacacatcagaaaacctcaaacatgaaatgtatgttcagtgaggcaaggagctccccgtctcttgaggtattcatcaggaggctggatgcccacctgacagggaggcttcagaggggagagaattatgcagctgagctgtaaacatctgcaattctctgattcctcctgggatcaaacttgcactggaacctttgctctgattctttgctatttcttctgagaagggcatcatgtgtctgttaccaccacgtcctagatcatgtgtctgttaccaccaggtcctagaatctcagaccagtggggctcagttcatcctaccttccctgcacttgaaccctagaacctaagaatgagcatcgtcttgaccctgctgccttgaatgagggtcaaggagaggggtgagtagaaggccagggttccttacagatgccagacccttaggagagggttggggggtgggcaggccgggagagctcagtaccttttctggtagaggggcagcacagtcgtgaccaggatgtagtaggtgatgacggcacacaccaccatggttacacccaggcaaagggctcgtgtctctccccgcttctgggccatcaccagcttcttcaccatattcactgggggcagtgatcatttctaggtccacagaagcaaacagaagtgagatcagcccagttcacaggtgatccacagaaagagaggacaggtgagaggggaaggtactcaactattaatatcactcttgtttatatttggagctttgcaacttccagaagtcttgctttttggaccccatgtaagccttccctgtgcaattgagaggcaattgcagataaaagacctacggctcagagaggtaaagtgacttgccctaggtcacacagtatgtaataggctcagtaatggccccccaagatgtctatgttctagtctctggaagctatcaatgttactttatgtggcaatgactttgcagaaatgattaagataaaggctcttgaaggccaggtgcggtggctcatgcctgaaatcccagcactttcggagaccgaggtgggcggatcatgaggtcaggagatcaagaccatcctggctaacatggtgaaaccccatctctactaaaaaaaaaaaatacaaaaaattagccgggtgtggtcgtgggagccagtagtcccagctacaggggaggctgaggcaggagaatggcatgaacccaggaggcggagcttgcagtgagcagagatgcgccactgcactccagcctgggcaacaaagcaagactccgtcaaaaaaaaaaacaaaaaacaaaaaaagataaaggctcttgaaatggggagacaatattggattatccatgtagctcctaaatgtaatcccaagggtcctaataagagggaagtgaagggagattaaacagatgagaaagctaaggtgatatgaccagggagacagcaattagagtgatgtgaccacaggccaaggagtgcgtcagaagctggcgggggcaaggaacaatggctcatcccccacggccactgcagggagtgcagcctgcagacaccttggtgattttggacttctggtgaaatttctgtcgtttgaggccgtcaggtttatgatcatttgctacaacagtcataggtcccatgcggtgagcgagcagtacatgtgcatcatccatgcacctccttccacggcacttatctcacagggatacttggagtatttctgcccagaaacagttctgtggcagggctagctgggccgggcacaggcagggaaaggagaggagggccccagaaggcagctgcaggttgtcaggagaggcaggaggtttaccatattccggtgttttttttttttgtaaggaacattcccctacttcaagcaaagaaagaagaaagaaggcatcatggtggcctcagcgactgctttcttatttcagggcttgaagccacctgggacaaagcagaatgggcacattctgctggtggttgctttccttctctcctctttctttaggcagcaactccttgtttttcccctggacattgactccaccccaatgcaagcaaagattccaccctcccctgctaggctcctgatcgctcccccaggagtgtgagtcttgacaaagacttcaagaaacagcccctcaatctatgccgcctggagccacagagatgcccagccatggtccccgcgtgatttcccatggttccgcaagctgtcctagagcctctggtaaatttatttgctgttgtttttatttgtttaaagtaaccagagtccatttctaccaaaaataccaggaagctatcaatgtaatcctccattttaggggaaattttaggggaatttaggggaaattttagccagatatcagggggactttattctccttgccaggtccctaaagtaataaacatattatggtttttgtttgtttaattagccagtgtccgggtgacaggccttagtccaaagagattttctgcaaagtgctctattttctgctcaggcgtctcttaactactagactgtttcaaatattcagagattcttgactccctccccttagccaggctgccctcatacccgggcatctccgctaaagggaagagaccagggtcaggcaccacggatacccatcacaccttcccagtgagctggtccacctcccctatcgatcggcagaggtgacatccaatgacaactttttctcctttatttggcaccaggaggtgagtttctcctgcattctaatggagacattataaaagcacaagcaagcagaaattgcccccgacaaagagagatgttttattcaactctttttattcaatccttttcctcctgttctgtgatcttgtgggaatgggagagcccatgcctttttctacctggcgtcagttgaacaagactctccatgtattcacaggtaaagcaacagaatcacctggaggtaagctaaaagccccaacagcctgcttccccaggacctgcaagggtcactggcacttggccccaccccagatactgtgagacataaatcatttgaagccaatgggaaatcccatcttggaagcctagggctgagtgcccacaacaaagccatttctctcctgggggaactggatcgcacctgtgggggcttcctgtggctccttcctggctaatcagccccccccagcgcccagggccatggcctcctctgctatttggcttctagtgccctctcaggcccctgggcactcctgaggctggtgaaggcaggaacctggttttaccagttttaggagctcagaaggaaaggaaaggagaggcttccctgtcacagagaagtctggaaacttggcttattcaggtctgacccgtctctaatggtctgatgagattgttgcctgcactgagtgagtttatagagtcatgataaatcctcctaagaccatgcgtggggttcagtgtagatatgacttcagcaagaagttagtattcagcatccaaagggagaacctttggcgggaggaaggatgggaactgtcaatatcccccaagggacagaaagaaaaggaagaagtgggtttcagctatcataggagggatttcagttagactgtaagaagaacttcccagttttgagcatttctaaatatctctgaagttccaggatatatcttcccatttagaaaggtcacttgagatctgggatagattcagagaagatggagaaggacaaaggaaggcaggactttggagtgtcctgggtgacctgatagctgggtcgacatccttttccttagaaggacaaggaatagagtacattgttgaacagtttggtggggtgtggacagggcgattctgaggtcctcagacatggaatcaaatcctggctctgccacttacacttagcaaccacatgactgtgaaacgagaaccatggtacctgcctcagagagttcagctaaagatcaaatgccatattgagtatcagacatgtatcatagcacctagccccaaatcagcccccagtaaatattagctattactactaacgaaggaaaccctgaaagtttggagcagaagtctggacccctcttgatgaatctatttttgtcccacctctctaccggtgacaagtgccagcattggtgttaatctccaggctgcagccttctggccactctgagaactgggacctagagggccagggcgcttactaccagagtaacctggccactgtgccaccctccccactggccaccagaccacgggccctccatccagaaggacagccccgagaggaagggagtcctcctgcctgcctccctccctgccccgtggcaggctgctttcccctgtctccctccagcccggtcttcagagaaatcacttcccaagtgctttcaggcccggtactcacagtcttcccggcgtcctgtgggtcttgagcagcagacagtttctttctgcctggacccccgcccccaccccaaaagaggccacagagcttcagcaggaagtttggcctccccgcccgtctccagggaagcagcttttggtccccatctggggcaagcctccatgcccaaacatggtcaagtctgagcacacagcctggagacacagactcggagagcaggtacccagccctgaggaaggcagctgttacccaagccctgcacctccatcttcccagagtctcgtgggaaacagatttcaaacaacaacagacagcaagactgagaaactacgaaagatcagcctggtatatttggaaatatttcttcttctctctgtctctgtgggctggcaaagatgccagaaataggaaatgattctccttttgttggcatgaggaagggtggagttgggctggaggggttgggcttgtcactagtccctggcatatccacgctggagcagctacagctccctgcctttggcacttacgtgctgtgtgaccctgagcaagttatggcacctctctgggcctcagtttccttttttgtttttggttttactcccaaacttatcgttaaatgacctcagttttctcacttgtgttactggcatttttaaaacctactttgctttagggtagtgatgggagttagagacggtggggatttatggcaaggggagagaactgactttttaaggaccaactgagctgaagctgggagtagtgagagctccacaactgcttccaaccaggtccagggacagtctgctcaccaggggccctcccagagaccgcgaaagtacagagatttcttcctagcaataagacaagtgaatgtcagcatttgcaggcaaaaaacatgcttttagatctctgcttcttcatctgtaaagtggaagtaaggattaaaaatcagcaacaaagggcaggcacagtggcccacgcccataatcccagcactttgggatgccaaggtagatggattgctcaagcccaggagtttgagaccatcctgggcaacatggcgaaaccccatctctactaaaaatacaaaaattagtcgggcatagtggtgcatgcctgtggtcccagctacttgggaggctgaggcaggagaatcgcttgaacctgggaggcggaggttgcagtgagtcaagattgtgccactgcactctagcctgaacagagcgagaccccgtctcaaaaaaaaaaaacaaatatatatatatatatatatattttcaacaaaacaacaaaaacaatcccagatattggggctttcctaagtatcaggcgtggtggtagaaggcagcttatctccacccttcacttgacccaagaatcaaagaacctgaaactgagacttggaggcttgaagtcactggtgcaaccctaggggccagaactagattcgaagctggcccttccagatggcacagcttggtctgtctctgatgaccctggggctgctctgagacattaaaaatcacctcgatcatacagtaagctgccacctgaggctctggaggtcaccctgagtttccccagcccccagggaggtgggtgcagcctggccttccctgctgagcgagctcaccaccttcctccctcctgcctccagcaggcgcgaaatgaaggcagccactcaggcctccctgacacactctcaggcggtgagtgcccttctccacccctttcctaattgaatcttattaacaggagactacagtgtctgtttaatgggcaccatagcaccagagggtctaagaccagcttcagaccttgcaggcagattgacagagggatgtaggatctggaattcaatctcagaagagcaattttccaaggatgatcctctgtccactcagaagcaggaaaagtcctcctggggctaatccagaaatgccaggcccccctcctgcttccctgggggagagatacacagtgcaacaggctgccatttatgagtataaccgaagggctccttgctcgtgatactctgaataagttattaagggctacatattatttggaaatcataaacaaactttagcattcttcccaagggaaggtgggaacaaacagggaaggggggccgtggggtcttctgctccccctaaatgagccacaaccaaaaggcattgacaagccctgtcctcgagggtttgtgggtgaaaacccaggtcctttgctggctgcggggttgtgtgtgacagatggctacaggtggagggcaagaaaataacaatgctgcaacaataaatattgacggtttgcattagtacggggtgtcagagatcacaaaatatcttctctgactcttccaacagcttcttaaggtactagcacaataggctcacaatagaccactgaggtggagatttttctacccatttgatagagggagtaactgagcctcagagaggtgaaataaattgcccaagcaagttactttgcctctctaagcttcagtttgtctgtctctaaaatagagataattatacctagcccctcagtgtttttgaggaatgagagatcacctaagctacctgacacatagtatggagattgtcctttccaaagatggtcacaccaaatacttcccattccatgtgcccttttcacagtgtggcatcaacactccaccatcaagaggggcattgatgtctcttccccttcaccctgggtggagcttcgtaagggcctcaatagtagaatatggtagaaggacacagcacgatgttcaaggctaagtcatagacgggggctcgagttccccccacacgctctcgggacatgtacctgggaaccagccaccatgttgtaggaagccgaggccccgtgctccagctgacagcctcagctcagatctcagccaacagctagcaaatctcaccgggcatgggagagaacaagcctgcagacagttccagcccccagcctgccagcctcccagctgaggcctcagagaatgtggagcagagacagcccacctgctctgtgctctctctgaattccagagccacaaaatccacgagaagaaaaaaactaatgtttcatgcccctgcgttttggggtaatttgttatgcagtcatagtaactggaacacacttgcaagtgatttcaaagggggactgttacagttgctggtgatagtggtaggattaaaccagtgagaattaaaacacctgagattgctatatggagtgttacaggagagtttagaaatgctttatctaggtagggcatggtggctcatgcctgtaatcctagcacttttcgagaccaaggcaggcggttcatttgaggccagtagttcgagaccagcctggccaacatggcgaaaccccgtttctactaaaaatacaaaaattagctgggcacgatggcaggtgcctataatcccagctattctgggaagccgaggcatgaaaatcacttgaatccaggaggcggaggtcgcagtgagctgagattgagccactgtactccagcctgggcgacagagtgagactccatctaaaccaaaacaaacaaacaaaaaaagtgctttatctactcttaggtcacacactatggcacaaatggaatagaagggcagtgatatgggagggtatttttgtttatgaagcacctactatgtaccagggaatgaccacatagatatgcaatacatacacatacacatacacatggacattcctctccacaatcccccacaaaaggccttgttctttctgtaaaagcacaaggcaaagtgattttcccaaggtcacgcccctagcgtgtgatgtgatggagcctggagtgcacctgtgcccgctgactccacagcccgtccctgcccctctgtcaccccatgactcccttgggagcagttttcaagagaccccaggtttcttcatgatgtctgcttccactgctttccagacaccctcagctcagtctgtacccctctctggattatgcacctgcttgtttatttaagtctttctgaatcaatatctcctctctgctgacacttgggataataagtcccataaatcaaattggcaactgagtcttgagcccctgtgtgtgcctctctgagtgctgcagggatgggtgttagtcactctcagtcctagcgaagctgtgcgttcacagacatcccagcacttgctatgcagaggctctggatacaccactgtgccgaggtgactcagacacggtcccttcactgcagaaaagcgatgccagatttcctcaactacaaaaatacagaacagaaagtgaaagatgtgttttaaatgagagacagtaataaaaggcagaggaaataacggtgggaggttttttagtagagttgagatgacaaagtataacaacagcaaaagtaaatgccgatattacaattaaatggtcacacaacaagacacgacaaaaaacatggtaaagttgttccctgctgtgtagggtgatactcactcctttttcctctgactcttttcaccatattttcccttggcctgatttttcttcctttatcctgccatgctgttaacataattgtaagcaccttgaaaatcctctttgagacaaagaggagcataaataaataaacagccctgctgtctgtctgtgtggtaaggttggtttttttaaaaaaatgctttttccttagtgcaaatcatcccagctctgtgggaaagtggcatgatgtggaagtgcagggagaagatgaggtacagtgttagcctcactgctcagagagagttgctgtaagagtggtggtggccttttcaacacacataaaggaagcatgtgccctctccttccatggcacatgtctcctctgtccttgcctcctggccagctcttcctcttccacaggactccccgctggggccttccctcgcccccagccccttagccactctccgcgcctcctgggccaggcggaagctctgcttccgcatgctgggagcaccgcatgcctcttctgcagaacacttcctccgcctgtaatttaacatttattcatgtgcatcctccattaacatgtctcctaacccaagggtaagctctctaaaatcagggactggaaccgttcttattcactgccgcatctctagcgccaggaggaataaacaaagatcttgcggttttgttgtcatcgtgctttggttttcgggaaaaaaaatctctcgcttttttacataacagaatattataatcattttcccatgccatgaaacatttttcttctttaaattgatatattatagtttcacagttgtacataaaacacttttctttcttgaattttaattatagattcgggggatacacgtgcaggtttgttgtgagggtgtaatgcgtgatgctgacgtttgagcttctattgatcccatcactgatagagtgaacatagtacccaaaaagaagattttcagcctttgccccactccctccttccttttggagtccccagtatctattattcctgtctttatgtctgtgtctacccggggattagctcccacttagaagtgagaacatgtgatatttggttttctgtttccgcattaatttgcttagcataatggcctccagctgtatccatcttgctgtaaaggacatgatttcatcctttgttatggctgtgtaatattccaaggtgtatacgtagcacactgtctttatctaatctgctgttgttgggcaccaaggttgtttccacacctttgctattgtgaatagtgcggcaataaatgtacaagtgcaggtctctttatggtagaatactttattttcctttgtgtatgcatccagcagtgggattgctgggtcaaatgatggttctatttttagttatttaagaaatctccaaagtgctttccacaggggctaaattaatttatatttccaccaacagtgtaaaagcattcccttttctctgcagccttgccagcatctgttatttttttactttttagtaatagctattctgactggtacgaggtgacatctcattgtggtttaatttgcatttctctgatgattagtgatgctgagcatttcaaaaacatttttctagaaaggctatacagttttctaggttatggctaagtcgggatagatttcatcaaagccatgttgtcagatatttaagaagggtacttgcttccctgcatgcttgtttgtgtttagcggaaggcagagtccgcctctgctatgggcagacctgttttattctctacccctgaaccacacccatgcccagatgtcatttttcatgaatggacaggtataagggagactgtatctataagcacaaagtttggggaccagaacaggtggatagagatggcaacatcatagaagtgggagatggtgacaggttggcaattgctcaaccctgtcccaggcctgacttgagccttagtgagtgagagagagcaagagagagaaagctgttgttagggcttgtgggactcagaacacaagaaatgccactttgggacctacgaagagggtgtttccacttctgcttagctgtggccttgggcagtggccctgacagataatggccatcattatcatctaaaatagctgcagcaaaggtagactcctgtgtgaatcggtgtccctaggtgtgctgcagctggctcacactggcaccgtgagagcctttgcaagccaagtgttcaaccatcaggagctgaaaatccaccacagtgatgggagtagctatactgtggaaatctacaaacaatacacatcagggcttttgtctttttggagagctgttttgccagcacaccactttagaggatacacttcaactgggaaacctgaggaggtattaggaatgaaggtgtggacaggttataggaaaccacagggaacagtgacctaggggctcgcaatgttggttgagggctgagggaagggagctctgtccaggatcagcaggagaatcttcttgagaggggatgctcccagcctggggagaccctcagggaaggaactggggaatggactgctatgctcactctcctggaatgtgttgatgaaaaagccaaactctgcaaattatttgaagagatttgttctgagccaaatgtgaggaccatgacctgtgacaaggcttcagaaagttctgagaacatgtgtccatggtggttgaattacagcttgattttataaatgttaaggagacagaagctacaggcagacatcaatgaatacacataagatttacattggttcagcccagaaaggcaggacatctcaaatggggatggattcaaagatttcctggtggattcaaagattcaaaggtggattcaaagatttcctgaatagcaattggttgaaataattaagttttgcctaaagagttgaagtcaacagaaagaaccacgaaggggggttatggaaactaaggttattattatatagatgaagcctccaggtagcaggcttcagaaagaataaatgataaatgtctcttaccagaccttagaaggtctgattagactcttagttaaatctctctgggatgagaaaaagacttagaaagggaaggggagtctctgcagaatgtagattttccccacaaatgacaactttgcaggactatttcaaaatatgtcaaataaatatagtttggggttaaaatacttgtttctttcagagcctgctatctgtcatgtgatgctatactacagtcaggttggaatttggtatttattactacaaagagtctgtttgtcatcttaagacctctgttttaatgttaatgctggtaagttgtgcctgaataccaaagggaggaaggtattttattaagaggcatgtccaacatcccctccccattatggcctgaactagtttttcaggtttctttgaaatccccttggccaagaggtgggatccattcagtcaatcaagcggcttagcattctatttttggcgtacagacccttctgcagacacctgatctcctttggttgaatccaactggtagacagacaaagagcttgttgctgcagtccccagtgatcagtttccagggcagagccagctagagagtgaggaggggtcaggaggggcttacatagatatcagtccatctccctgtgtatgtggctttgggacaggaaaactaggtaagagcaaaaaaagagggcttgagcacatggggactccctgcaaatcccccagaaatatttgtaggggtctgaaaggtatgtaggtagggactctaaacatttgtaagtcaaattttatgtggctaatttggagccccaggctggtaagagctcaggaaactcaggttccataaacagtgcctcattaaatattctttgcataaaataggttgatgaaaagagtcaaactctgtaaaatatttgaagatatttattctaagccaaatatgagtgaccaatggcccatgatgcagccctcaggagaccttgagaatatgtgcccaaggtggtcagggcacatcttggttttatacatttttgggagacatcaatcaaatacatttaagagatggcttggttcagtccagaaaggtgggacaacttgaagagggggctgccaggttataggtagatttaaacattttctgattggcaattggttgaaagagttataatctatagaaagggatgttggggttataataagaggttgtggagactgaagttttatgatgcagatgaagcctccaggaagcaggcttcagagagaatagattgtagatgtttcttatcagacttaaggtttgtgttgacgttaaatgctggtcagcttttcctgaaatccaaaagggaggagggcataatgaggcatatctggacccctctttccatcatgacctgaaccagtttttcaggttacttttggaatgccctggtgagagaagggatccattcagatggttgggaggaccttaaaattttatttttggtttacgaatgtttgcacactttttgttatttccctagaataaagactggacctccaagccaaaattctagggcaaaaggtttctacatttttaagattttggtatatatttcacaccttttaccagaataccgataccaattcttgtactcactgctggtagaggagactggttaatttcacacataatcaccaattcttaacactcttaaatttggaaatatgtgtcttttggctaggtgaaaactctttcatctgtttttaaatttgctttctttagattactagcaagattgtacagtcctttatatgttcattggaagtgaaatattttatttgtcccaaattgtgatcaggaataaataagaagcccctgttttagaccattctaactgtcctttttctctggcaagattcagaggcccaatcttcatcagctgctctaagtggttcaggtcaggaccggctccaggggctgaatgccccaccccaatccctcccagcctctcagcatgggcagggggttttgagattataaacaggttattctgtaaactttctttgctgagccatagaatgtcagccctctaagggcccttagaggtcatctaggcttgttgctggaaaagagggtcctgatccagacacctagagtggattcttggatctcacgcaggaaataattcaaggagagtcacagaggacagcgaaagaagcaagtttattggaaactactttgttacagagtagggcatcctcagcaggaggaggagcatgccatcctttgtgagtgtgtctacttgcaagaaattagaaggagctctacacttggaatgtgtagatgtgcttaccaaaggtaagggctattggtgttatcaatgaccatgaatcttttaccctaagcctgctaaccgatgttatctttaagtaaaattggctgtactcttaagatatccggacattgtacaggcttgctgggagatgctctgtatggccataaatattacataattataagtggtggtcagcttagaatttggctattttcagaccattagcattaaccttaaacacgctttgtgaatgcctgcctgctcacttcaatatggagtcactctagtcgcattttattaaaccagaggcctggtaaacaggggtttctataacaggcctacatgaccactttgtccttgagtaatgttttctatttacaaagtaatagaggtaagtcatagagaacttgataatacagaaaagtaaaaaagggggaaaataaaaatcaatcaagattcaatatcctgaggaaaccacagtcaaaatattagtggattatgttctaaagattgatacaaatcctttctaaaaa

SEQ ID NO: 1117 - DNA, 27526 bp, Homo sapiens
aagcgcctgtaatcccagctactcgggaggctgaggcatgagaatcgcttgaatctgagaggtggaagttgcagtgagcggagatcgtgccactgcactccagcctgagtgacagagcgagactccgtctcacaaaaaaacaaagtagggtctctggtcgaattccagtgctccttcaattatgccacaccttgttgacatcgccatagaacagtaataatacggacatacctcattttattgcatttgctttattgtgcttcacagatattgcctattttataaatggaaagtttgtggcaactgtgttttgagcaagtctacaggtgccgttgttccagtagcatatgctcgcttgaagtctctgtgtcacattttggtagttttcacaatatttcaacccttttcattattttatatctgttatggtgatccgtgatcagtgatttttgatgtccctattctaattatttggggccaccacaaacaacatccatataagacggaaaacacaataaataaatgtgtgtgttctgactgtcccactgactggcaatgccctgtctccctccctctcttcaggcctccctattccttgagatacaacaatattgaaattccctgacacaaaataatattgaacagttaatagccctacataatggcctctaagtgctcaagtgaaaggaagagtcccaggccaggcatggtagcttgcgcctgtaatatcagcaatttgggaggctaagactggaggattgcttgagctcaggagtttggaccagcctgggcaacatagtgagacaaaaaataaaattagctgggcgtggtggcacatgcctgtggtcccagctacttgggaggttgaggtgggtgggtcatgtgagcccaagaagttgaggctacagtgagctgagattgtgccattgcactacagcctgggcaacacagcagatccccatctccaaaaaaataaaaataaacaaaggaagagtcccacatctcctactttaaatcaaaagttggaaatgattggctggacgcggtggctcatgcctatcatcccaacattttgggaggccaaggtgggaggcctgcttgagcccaggagttggagaccagcctgggaaacaaggcaagaccccatctctacaaaattttaaaaattagttgggtgtggtggcacacacctgtggtcccagctactcaggaggttgaaatgggaggattgcttgagcccaggaggtcgaggctgcagtgagccatgattgcgccactgcactccagcctgagcaacagggcaagaccctgtctcaaaaaatatgtaaaaatgaaagaaagaaaggaagaatcaattgatgtggcaaacttctctgttgttttattttataaaattgccacagtcactccaaccttcagcaaccaccatcctgatcagtcagcagccatcaacatggaggaagagcctccaccagcaagaagattatgattcagtgaaggttcagatgatggttggcatttttaacaataaagtattcttaaattaaggtatatgcattgttttttagacataatgccactgtgtacttaatagattatagtataggctgggtccagtggcctgtaatcccaacactttgggaggccaaggcaggaaggttgcttgaacccaggagctcaagaccagcctgggcatcataatgagacctcgtctctccgaagatcagaaaactagctggtcatggtggcttgcatctgtagtgccagctactgggggcactgaggtgggagaatcacctgagcccaggaggtcaaggctgcagtgagccatgaaccccaagccactacacttcagcttcagtgagtatagtatagtgcaaacataacttttgtacgcaataggaaaccaaaaaattcatgtgccttactttattgtgatattcgctttatcgtgatggtctaaaactgaactcacagtatctgtgagatatgcctggactaatatccaatgttgattgagctttttctaagtcccaggtgctgccacaagtactttttattccattttatttatttatttatttatttatttatttatttttgagactgagtctcgctttgttgcccagggtggagtgcagtggcacaatctcgtctcacagcatcctctgcctcccaagtgattctcctgccttagcttcctgagtagctggtattacaggtgcctgacaccacatccagctaattttttttgtattttttgtagagacaggtttctttgccatgttgcctgggctggtctcaaactcctggcctcaagtgatccacccgccttggcctcccaaagtgctgggattacaggcatgagccaccacacctggccttttttcttttttttttttttgagacagtgtctcactttgttgcataggctggagtacagtggtgtgatcacagctcactgcagcctcaacctgcgctcaagtcatcctctcatctcagtcccccgagtagctgggactacaggccggtacaaccatgcctggctaatttaaaattttttgttgagacaaggtcttattatgttgcccaggcaacataataatagtgaatttgagctcaagtgagctcaagtgatctgcccacctaggcctcccaaagcactgggattacacgcatgagccaccgtgcccagccaggtctttttaaaatatctccatgtctctgttccatatattcaatctttccactagcttctttaacacatacaatagggttacaaccactgttttaagtctttgcctactatttctaccatctctggttttgtttatcatctatcatcataatttctggatcagtttctaccgattaattattttcctcctgtgggctgtatttttccactttttttgcaagcattatagtcctagacaaactcctcagctttttttataggcatggttaagtaacttgaaaagtttgattctttcactgcttgcttctttttttttttctttttcttttttttttttttttttgagacagagtctcactctgtcgcccaggctggagtgcagtggtgtgatttcagctcactgcaacctctgccgcctgggttcaaatgactctcctgcctcagcctgccaggtaacagaggttacaggcatgggccaccactcctggctaattttttgtatttttattagagatagggtttcactatgtaggccaggctggtctcaaactcctgacctcaaatgatccgcccacctcagcctcccaacgtgctgggattacaggtgtgagccaccgcgcccggccctgcttgcttttaagctttaagtagaaccagaacagtatttaatttagggtaaattttctccactgctaatgcaagacctttttactctgagtccctgtgaattataaggtctttctctctggctgttgggaatatgcacttttcctggtcctgatctctggacactgttcctactaatcttttctctacccagctttgggtggtttcctcgcatatgtgcactgatgagtacggcactgaatactcaagagggacctcatgcagatctccagagtcttctctctgtggagtcctctcttctctgatactctgccttgaaactcttgttgtttggcttcctgggattcccagatctttctcttcaattcaaggtaactcccagtctctgcctgggttcccctccctgcaccaggccttgaatatcttctccagtcagcaagctggagtaatcataggacctatctcatttgctccctgtctctgagttccttgtccttagttgcctaatgtacaatgtgttgagatctgttgtttcacatattttgtccagtttttcgttgtttcaggtagaagggtaaatccagtgtctgttactccattttgcccaaaaagggacatctctagggatatttatcacaattgctttgaagttctgctctccatatcctctttcctccaagaaacattctgttatttttgtttcttcctattatttaatttaattaattaatctatttatttatttatttatttatttatttttgagacaggatctcactctgtcacccaagctggagtgcagtggtgtgatctcagctcactgcagcctccacctcctgggctcaagcaatcctcgtggctcaggctccccagtagctgggaccacaggcacatgccaccgtgcctggccatttgtttgttcctaattttaacattataagctttcttcaaatgtctgtctcttggctgcgcacagtggctcatgcctataatcccagccctttgggaggctgatgcggcagatcacttgagcccaggagttcaagaccagcctaggcaacatggcgaaaccccatttctactaaaaatagaaaaattagctaggcgtagtggcacacacctgtagtcccagccacttgggaggctgaggtgggaggatcacctgagtccaggaggcagaggttgcagtgaaccaagatcatgccactgcacttcagcctgggtgacagagtaagatcctgtctcaaaaaaaaaaaaaaagtaagttactgaaaacagcaaaagagctgatttgaacctctgtataggtatagcagagcttgccggttacatctctaatattcactttctccctctctcttaaagaacacaattgtgtggagatggtattatgcccagcacacacacacacaaacaaacacaaaagcaattacattttccagtctctcttgtatactgtgtagaggtgtggccatatgtcacaattctagccaacaaaatgtaaacagatgtcattggttgggacttctggggaagtcccttaaaatgaagtgtatctattttctattagtgaatgacaaaccactccaaaacatagaggggttttatttatttatttttcatttttctatttcaaactacaatcatcaatagaacagagaggtttaaaacatcattatttactcatgattctgcaattcgggcaggtctccactgagcaatcctggggtcactcactcggctgggtcatctggtagttcatttggggcttgatagcctcctctattccccctctcataacctctccagtggaattgcctggttttcttttatggcagtggaagcattccaagagagcaaggcccatgcacaaatgcttatgaagccttggcttgtgtcatatttgttgatgtcccattggcaaacaagtcacatcaccaagcccaaagtcaaagtcgcagagggctatgcggttctatcattgagcagtgaagcagcctacagctactctgggaagcattcgtgtcgccagatgtggaggcaaccctggagttggtgaaggaggcagttttttggtaagcctggaagtagttgtaacaccacttgctcgatatgggaccctcttaggacataccaaaggtcttgtgctcagaacaatcacatagaatagcaagttgggaacttttctatatataatcctcaagcctttagttaaatgttgatgcatattatccctggcattagcatggtgtgtccatgctcagaccaaagtaataaagaggaaaaaaaatcccaccagtaacgtccattgatggtagttctacatagaccctaggaaaatcatgatccgggaaatgcagcaatttgaacaatgggccaagtggtactgattagcctggagcaaggtaatgatttaaaaaaaaaaaaaggctggaacaaagaatgattcacactacaagtacaccaccaccaatcccaaggactcccagaagcagctgaaaaagactttgatggagagggaagtcaaagttcttaggccaagtagatatggacttagtgcatcaagtaagtttggatcaatatcaaagtaaaaaagggagactgttgtagactaagagactaaagctgtttttctcaaattttgatgaattttagaaatgcctgaggaagatttttaaaacccaatggtcagaccacacccaaaacagttaaattaaggtctctagggatggagcccatatttcttaaggctacttgactgattgattccaaaatgtgaccaaggtgagaatctctgaactgaagaaaacctaacaaccaagtgtaatgcatgaactttgattggactttttaaaaagaccataaaatacatttgtggaacaattgtcaaaatagataatacattacatgtaatattttagatttgttaattttttttctttttttgagacagagcctctctctgttgcccaggctggagtgcaatggcacgatcttggctcactgcaacctccacctcccaggttcaagcaattctcctgcctcagcctcccaggtagagggcactacaggcacacaccaccatgcctggctaatttttgtatttttagtagagatggggtttcactatatggccaggctggtctcaaattcctgacctcaagtgatccacaagcctcggcctcccaaagtgctgggattacaggcgtgagccaccatgcccagcctagatttgttaatttttaaagaagtgataatgtgggctgagtgtggtggctcacacttgtcatcccaacactggaaggccgaggtgggaggatcacttgagcccaggagttggagaccatcctgggcaacataaggagaccccatctctacaaaaaattttaaaaatcagccaggcatggtggtacacacctgtagtcccagctactggggaggctgaggtgggaggattgcttgagctcaggaggtcaaagctggagtgagctgtgattgtcctactgcactccagtctgggtgacagagtaagaccctgactcaaaaaaaaaaaaaaaaaaaaaaaaagaaaaaagaaaggaaggaaagaaggaaggaaggagagagaaaaaagaaataatggtaatcgtgttattcttaggagatgtaaactgaagtatttaggtggagggatgttaatatctgcaacttaccttcaaattgttcagcgaacgattataaatgtatatatgcatgtgtatagagaaagatcgcataaatgtgtcaaaatagtaataactggaggagctaggtacaaagttcaatgtgggccagatgcagtggctcatgcctgtaatcccaggattttgagatgccaaggtgggcagctcacctaaggtcaggagttcaagaccagactggcctacatggtgaaaccccatctttactaaaaatttaaaaattagctcggcgtggtggcacacgcttctagttccacctatccgggaggccaaggcaggagaatcacttcaacccaagaggcggaggttgcagtgagccgagatggtgccactgcactccagcctgggcaacacagtgagaacctgtctcaaaaaagaaaaaaattaaatatactactcttttaccttttctgtgtatatgaaaactttccaaataaaaagtttgggaaaagttatttggggaattaacatatgaacacctgtactcataagcagatgaaatatccctcttggagtaccatctgagatttttttttttttgaaacaaagtctcactctgttgcccaggctggagtgcagtgggatgatctcagctcactgtaacctccatctcctgggttcaagtgattatcctgcctcagcctccaaagtagctgggattacaggcatgtaccaccacacctggctaatttttttgtattttcagtagagtattttagtagaaaatttagtttcaccatgttggccaggtgggtcttgaactcctgacctcaagtgatccacctgcctcggcctcccaaagtgctgggattacaggcgttagccactgcacccttccccatctgagtttattaaaactcatgtaatcacgtatatctgcaccagggcaagactaaagtgaggtcagcgagaagcctagtcctggccctgatacacaccatagattagaacaagttggtaattagaatggggtccataccaatgaagaggagtggtcacccctggtttgggtcgaccagtgaactgctattggcctgaagttaatgagactctacagcagttgtcagccttaactgcacaatgaagtcatctgaaggagctttaaaaaatattctttcctgggccccacctctagagattctgatttgtttcaggtgttgcctgggtatgccctacattggagggttttaacttatcccaggtgattctaattaatgtgcagccaaagttgagaaccattgctcttcatactgccttatacaacctggacaactataaagggattggtaaggttctcagggagaacaggtgtgtggttttaccagagttggaagagacttttttattatcatttgagactcagagagattctagcaataggaggagccagaaagttcttttatttttttaattttaaaatttaaaaatagagacagagtctcactatgttgctcaggctggtcttgaactcctgggctcaagcaatcctcctgcctcaccctcccaaagtgctaggattacaggtgtgagccaccatgcctggcctagaaagttctcataccatggagactagaccttttttctcaagggcaagggacaatatatttaaaatacttgggcataggagcaaccccacaggcccaaacccggagctctcaaagggatgggatgaattactgttgtcagttgtaagtattagagacagctgctcagccttttgaagaaatggcaaggaacagaaaactgaaagtatcctcaaggagtcagattctaacccaaaagaaaagtttctggacattggttgaaatatacatgacactgcaggaggggaaggtatcacaaagtgaaaaattcagtggtttgtgaaaggtctggctagacacagtggttatcccattaggaggcaaagccaggttcttataggtacacatggtctctcttgagtaggaggtcacttccagatctgtcaccacagaagaggtgtcccaaagggaaaagaaataaagcgagagaggattgggtaggcagtactcattctagcttgcctgggacttccaagttggttttatttatttatttatttattttttgagacagggtctccctgtgtcacttaggctggagtgcagtggcgagatcttggctcactgcaacctttgcctcccagattcaagcgattctcatgcctcagcctccaagtagctgggactacaggcatgtgccaccacacctggctaactatttttttatttttagtagagacagtgatatggtttggctgtctccccacccagatctcatcttgaattcccacatgttgtgggagggaccttgtgggaggtaattgaatcatgggggcaggtctttcccgtgttgttctcgtgatagtgaataagtctcatgagatctgatggttttaaaaaggggagtttccctgcacttgctctctcttgtctgttgtcatgtgagatatgcctttcaccttccaccatgattgtgaggcttccccagccacgtggaactgtaagtccattaaaactctctcttttgtaaattgcccagtctcaggcatgtctttatcagcagcgtgaaaacagactaatacagatggggtttcaccatgttggccaggctggtcttgaacccctgacctcaagttctctgcctgcctcagcctcccaaagtgctgtgattacaggcgtgagccactgcacccgatgagacttccaagttttcatactggaagtcctgtatcccaagaaaccctttggtcccaagaaagaaaccctatgtcccaagaaggtcccagacaacccacatagctgatcaagctactatgcagggaagggggtcatataattcagacctggacttggagaagaatgaatgtctacatgtatcctcctttagaggacaagtcctgtattagggtgagaagcagaaccaaaactgagactctcgtgcaagtggtttattgatggagtgctcttaggagaaggggagtgagggaagcagcgtaggacagaggaaaaaaactgagtaagaatgtgctctcagaagaagactgacttcagcttgattccatgaggagctctgggaaaggaagttccttgatgtaagaggtcagtcttttgtacctccatacaagaggtagcaattcttttctagagatggtctcaaaattagaatacatcaaaatcacttggagggtttggtaaatcagaatgctgtgccaacccccagagattctgattcagtaggtctgaggtggggcctgaggatttgtatttccagcaagttcacaggtaatgctgatgatgcactttgaaaacctccactctagagaagaggacagctctgaggtgttagcacccacagcatctcgcaaaggggatcaggaaagcacctactacatgaaggcacatgccagggacagatggattggaccccaagctggggctatgtagactacatctttaggtcagaacatctagattcacagtatcttgtatgttcctgttgtcatctcacatctcttgccaacgcattgttgaaacattcttacttggtcttgttattggacttcaagagaagggtctgggagatacatgaggctttgaaaaggaagtagctgcaagttgctaggcaaatatagtggcatcagttgcaatggagtggaaagtccttaaacgagtgatcaatatttagtggcaagactctagaccaaccctggaaattgcctgatgtttgtgaaattaaaagaaaatggctttgatggcaacttttaatttcataagccacgccagaattcataacagtctctgctcctgaggatcaccaccaggtgaaggtgaatgaataaatgttaaaatggaattcgtttcttttggtggggtacgtcaggtagaacttggagaataccttgtacccctgggccttaatgtccatctccaggcagtgcatgaggtcgctgttgtctaggaccgccttccagggcccaaacttgacaacagacttgaacatcttcttatcctgcagaaaacacaggacctctgaataatatgcatcctgctcctcagtttccaccaggcacacaagcacgctggacttccgtgctgttatggcttctgcacgtgccaggcgcaccatgagctccaggttctcgctgtagcccggcacttgcagcaaaaactgcttccgagacacctgctcaccaaagatctgtggcatgtcctccagcagcttgaccaaaggcttgatttcgtagaactgagcctcacggtacacttcagggatgtgctgtgtgggcacttgcccagtgcgcaggtagtccaggatgggtctgaaataggtgctggggcggtcgatgaagaagcggccctccgcgtccgtggaggccttggctaagctagagaacatctctgccagctttgagcccggaaacttcctcagggtacccagggtggtggtgtggaactcacccccgacgttcagctccacaacagtagacatctgggggcacaagaggcagagtaaaccaacacgccatctcccctgagcgcattacttatttttatccaaaggataactggataaaaaacttaggggagccataatgattggcttcagctagtgaaaggcccatcttactaaagagggttatatttatgctgtgttgctccagggggtgggctttttttttttttttcgacggagtctcgctctgtcacccaggctagggtgcagtggtgcaatctcggctcactgcaacttccacctcgattaaagcaactctcctgcctcagcctccctaatcgctgggactgcaggcgcctgccatcatgcccaactaatttttgtatttttagtaaagacgaggtttcgccatgtttgctagtctggtctcaaactcctgacctcacgtgatccgcctgcctcagcctcccacagtgcccggccgagggtgggcattttaaagaggaagaaagatttctgtttgaaaaaagaatacccattcaagcatcttaattttaggtcatagaatgttatgggaggaggccaggcacggtggctcacgcctgtaatcccagcactttgggaggatgaggcaggcagatcacctgaggtcaggagttcaagacaagcctggccaacttggcaaaaccctgtttctactaaaaatacaaaaattagccaggtgtgatggcacgcgcctgtaatcccagctactcaggaggctgaggcacaagaatcacctgaacctaggaggtggaggctgcagtgagccaagatcaccccactgcactccagcctgggtgacagagtaagactctgtctcaaaaaaccaacaataacaacaacaacaataacagaagaacgttatgggaagaggctgccatggaaggaagtctcagcaatgatacttccaaagtctgtggcctttggcaagcctttttccctcttacagcctcagtttcctcatctataaaatgaggatattggccgggcatagtggctcatgcctgtaatcccaacactttgggaggccaaggcaggaggatcacttgtggccaggagttggagaccagcctaggcaacatagcaagaccccatctctgttgttttttaaatagatttaaggaaaaaaaattttttttttaagtaaaggccgggcatggtgcctcacgcctataatcccagcactttgggagaccgaggtgagtggatcacttgagaccaggagttcgaaaccagcctggccaacatggtgaaaccccatctctactaaaaatacagtaattagccaggcatggtggcacgtgcctatagtcccagctgctcgggaggctgaggcaggagaatcgcttgaacccaggaggcagaggttacaatgagctgagatcatgccaccgcactccagcctgcgcgacagaatgagagtccaactcaaaaaaaaaaataagaagaagaaagtaaaatggggacgtggagttgttatgaagtcaagagtttccaacctgggatgctcaactctgatctaagatataataaaagctgggggtgaagtaggagggacaattccaacatttcagaaagactaaagaaaccatacatgtgttcattcaggaagaatttcttgggtatttactatgtatccacatcctgtgctgggagttggggacaaacattcttatttcatatagattagaagttctggttaacagttcacatgcccttgattgatttaaaaatggaattttttcttttctttttttttttttttgagacagagtctcgctcagtcgcccaggctagagtgcagtgatgtgatcttggttcactacaacttcagcctcccaggctcaagcgattatcgtgcctcagcctcccaagtacagatgtgcaccaccatgcctggctaatttttgtatttttagcacagactgggtttcaccatgttggccaggctggtctcgagctcctgacctcaagtgatctgcccacctcggcctcccaaagtgttgggattacaggcgtgagccacagccccggccagaaatgaatttttttttaagagatgcggtcttgctctgttgttgcccagactgggtgtgcagtggcatgatcataactcactgcagccttgaacttgggctcaagtcatcctcctgcctcagcctcccaagtagatgggactacaggacattcaacactgcatctggttatgtaaaaaaatttttttagagacgggtcttactatgttgcccaggctggtcttgaactcctggcttcaaggcttcctcctgcctgagcctcccaagcaggtgggattacagatgcaagccaccacgcccagcaaaaatgaaatttgtttgatgaatgtttttcaaaatataggcccatgagacttaaataataacgggaacattcttcgtaatgaaaaggccggtaactctacatattgtgggtgtaaaactgcttcacaaactgcgaagtgcagtgcaaatgcaagttaagtttggttgttcaacaaaacttttagaggccacctctctgtgccagaccctgggctgagcactaagactggttattaagtgatgatgtcagaatctgaactcaggtccgttttactccaagcttgagctcttagtcattacataaattaccttcagtcttccaataccttcactcttcattcccttagtgactcattcattcaacaaaatgtatgttgggcctattacatgcaaaccttgtgccaaacagaagaacaggacacagtccctgctttcaaggaactcacagtggagacagcgaaatagacggcttaagcatgtaggtgctgagagggaagactgaaaggtaggaggggtcaggtctttttgtggatgtgggttggaggctgtcagagaaggtttcctaagggatgtgatggccgctgctgctgaggaatagatgcatagtgttagaggaaagatttaaccacaagagtggggatggggacagggctcaggaatgtccctcagtctgatttaggtgtgtcctcattctcaactggtctgtgggctctcctaagattaaagtactggagttaatagagccaaagtcaaccgaactgctggagaaatctgattgccatgacaacatctcctaccaggggacagttctgctgactggaagggagaaggcagaggagaggacgcatcttgacagcagccaaacaatagagctgagaaaaataagcccagaacctctgattctttctcccataaacctcaaggccccttggcagggctgtttggttaaccctgaagtcacctctgtaaagctcgcagttaaatgcaaagctgcagagtttaacccttgaatggaccaatatgttctcattactcctacaccactgaaagctctcaggtcctcctaatgtccccatgttacaggcaaggaaagctcagacagaagtcacacagctaggatgtgatgaagttggagctgagatgatacctgtattagcatgactccaacacagtaagggtgcctcaccgccatccttcccaacatcctgcccccctactgccaatactttgatatgtgcccagggccctttgctttccgtctctggaactaagcttagtcatctgtgaaatagggaggcaaaatggaccaaaagaatgctaagcttccccagctctgaaagtctaacagatccaatcacatcaaatatcctttctgaagctaatttccagatgcttcaaaaaaacaggctgggtgcagtggcttacgcctgtaatcccagcactttgggaggccaaggtgggaggatcacttgaggccaggagttcaagactagcctggacaacatggcaaaaccctatctctactaaaaatacaaaaaattagctgggccctggtggtgcatgcctgtaatcccagctacttgggaggctgagaattgcttgaacccggaaggcagaggttgcagtgagccaagattgcactactgcactccagcctaggtgacagagggagaccctgtctcaaaaaaaaaaaaaaaaaaaaaaaaaaaaaaaagtttcctgcactgacatcttcagctccatttctttatcaaacaagacctcagccgtgttcctaagcttctttttgttttttgtttttgtttgcttgttttttgttttgagacaaggtctcactctgttgcccaggctggagtgcagtggtacaatctcggctcactgcaacccccacctcttaggctcaagcgattctcctgcctcagcctccagagtggctgggactacaggtgtgtgccaccatgtccagctaatttctctattttttatacagacagggttttgccatgttggccaggctggcctcgaacgcctgaggtaggtggtccacccacctctgcctcccaaagtgctggaactacaggcatgagctaccacgcctggctgagagtacgttttctgaagtacaaatctgatcctgtcactccctgcattaaacacttgagtaacttttcattcccttccagataaacagcagactccataacaaggtttagaggccctttgcaactaggctgctacttcacccctcgcaatcaactaccagaactgcctgctgctccccactcctccaatccagagctgggcaagccccctcacctccagaagctcactcacttggccatccgcactcctttctctgaccccactcatccttcagatgaattcctctgggagtccttcggggtgggttgtctcactgtgatcccagaaagtcctacactactatacttccactggcctggcagttcttcccttgcaattccctgtttcttcattgactgtgaggttcctggccaagtgctgtgtttcatgcctgtaatcccagcactttgggaggctgaggtaggaggattgcctgagcctaagagtttgagaccagcctgggtctcaccaacatggcgagaccccatctctattttaacaaacaaacaaacaaacaaaaactctgtgaggctcctaagggaggggaatatcctctgatttacaggagcatctagtattctgttcaaggccaatcttgccctacctggcatcatgcacagtgccttacacttccccagtaattcattcaggcatttatggaacacctagggtggtcctggcactaggcatgtggctttgtcaatagccaacaacaatgacgtgatcatggccctattagagagagccacgctgccctgctgctggatctgctttctcttcctccaggtcttcaggatgactctcagtgcaggagagaacccgaatgttctgctcccagagtgcacgcagccttttccccatcctcctccccaactcccctcacccaagctggggaccaggcaggcaagcagagggatttgggacccagccagagggcaggggcaggctgaagacccagccaaggggcaggggcaggctggagagggctgcaggtgagggaaagatcctctggccgagctggttggatgggcttctcccaccgggagcaagggagaaggtggggcagaggaggagtcgtgggctaggacaagccggtggggaagagacaagggaaaggaactaaagacccaatgtagagggaggaagcaaaagggcaaagaggaaaggctggacagagccaaaccagaaagggacaccgaggcgcgaaaggagagtgatcccagcaggagggacggcaaagattgaagagagcgaccagcccgaggtgaagggggacagcgcgccagaagcagggggctcgggcgtctgggagggacgggcaggagaaactggaagggagggaagaggcggagggaagaggcggaggacagaggcgcggggacgcagctagcctcgcacttaccgttggccgcctgggccggggggactggggcagaggggtctggctcgtcatcctgcccactggccgctccactgcgcagccctgccacatgcagatcacttgggccagcggaagtgcccctggctgcccgcccctaggtgggaacaccgaggctcaaggcgggacggggctgagccaggcgtggcttgcagtgagactgggccaagtgcagaaagaaatggacagtctgtctatttggggcttctaaaagttgttaggccctgagaagggctgactttggagaccgagaaatggagcagaccccttaaggactgaccttttgatatagattaatttccttccttttctttctttctttcttttttttttttcagagacagggtctcactctatcgctcaggctgaagtgcagtggcggatcaggctcactgcaacctcaacctcctgggctcaagtgatcctcccacctcagcctcccaaagtggtgggattacaggcctgagccacggcaacttgcctcttcctatattttcttttacgcttaaataaattacttaaacatattgcttgaatcccgttattaaagttgacattagttaatgcccctctctgggcctcggagttcccagtagtgaaatgggggaggcagaaggaattgacattgactgacattgacaaccagagactttctattccctacagtcctagggagtgaaagatccgcaacacccattttacagatcagaaaactggcgctctaggaggtagggtggtgttaaaatgtaaagtctgaggatcaacaaaacttttttaagagtatacttgagtaacaggcaattcttgaatcggggaacaccagatggaaagaggttgagtgttcccatgacaatgcatcagaggcaaatatttatggggagaatatggaagcaagatattttgttggggacaggcatggtggctcacgcctgtaatcctagcactttgggaggccaaagcggacagatcatttgaggtcagaagttcgagaccagcctgaccaaaatggtgaaaccccgtctctactgaaaatacaaaaattagctgggtgtgatggcatgtgcctgtaatcccagatactgtggacgctgaggcaggagaatcgctggaacccgggaggcagagattgtagtgagctaagattgcaccactgaactccagcctgggcaacaaagattccctctcaaaaaaaaaaaaaaaaaatatatatatatatacacacacacacacacacacacacacacacacacatatatatatatatacatatatatatataaaattggttacagttaaaaaatctccttttttggtttcctttgttgaaaagtccacagctacttaattgtatgttagttggctgcttgtggttggctaatgttaagtttcgtttctgtctaacattagcatttaccagaaatgactctattagtcagggttctacagagggacagaactaacggaatagggttggacacggttgctcacgcctgtaatctcagcactttgggaggccatggcaggtggatcacctgaggttaggagttcgagaccagcctgactaacatggcgaaaccccatctctacaaaatacaaaaaattagctgggcgtggtggtgggcacctgtaatcccagctacttgggaggctgaggcagaagaatcgcttgaacctaggagacggaggttgcagtgagctgagatcaagccattgcactccagcctgggcaacaagagtgtaatcccatctcaaaaaacaataataataaaataaaactaatggtatatatacatacacatatatttgtatatatatattccattacttttttaactccccgttatatatatacatatgtgtgtatatatacacacacacatatatacacacgtgtgtgtgtgtgtgtgtgtgtgtgtgtgtgtgtatatatatatatatatatatatatatatatatatataaaggggagtttattaagtattaactcacacaatcacaaggtcccataacaggccattggcaggctgagaagcaaggagagccagtccgagttccaaaaatgaagaacttggagtctgatgtttgaaggcaggaagcatccagcacgggaaaaagatgtaggctgggaggctaggccagtctctcttttcacatttttctgcctgctttatgttctagccatgctggcagctgattagattgtgcccacccagattaagggtgggccatcctttcccagaccactgactcaaatgttaatctccattgggaacaccctcacaggcacacccaggatcaatactttgtgtccttcaatccaatcaagttgacagtcagtattaaccatcacattgacccaagttaagttttgcttatgtttgcaaatccagcaaggctgagttcccttatgaggcctaactagcattgtctagccagggattcttcaggcctgatctccattttaatttactataacagtggccagtgtagactatttagccagcccagggcagctgcttggagtacaaagcatgcccactggtgaaaagagttaggtatctgttttgtggggttgttttcctagagttaaaatataactctaaaggagagggagcataatttcccactccttaagtgtgggttatgcgccgtgacttcttccaacgagtacaatatgggaaggaggaaaaagagaagaaactttacattggggaaactgatcaatactactccagccaggtgaccaaaatcagttgccaacagttatcgatcatgacaacagtatgtgcttgctgtaaaccagaaagtatctgagacaagtctcaaccaatttaaaagtttattttgccaaggttaagaacatgcccacgatacaacctcaggatgtcctcaggtcatgtgcccaaggtggtcaggctacaacttggttttatatattcaaggagacataagacactagggccacgcatggtgactcacgcctgtaatctcaccactttgggaggccaaggcaagtggatcatttgaagtcaggaatttgagaccagcctggccaacatggtgaaaccccatctctactaaaaatgtaaaaattagccgggcatggtggtgcgtgcctgtatccccggctagggctactaaggaggctgaggcaggaaaatcacttgaacccgggaggcagaggttgcagcgagctgagatcgcaccattacactccagcctggaagatagagtgagactccatctcaaaaaaaagaaaagaaaagaaaagaaaagacatcaattggctaggcatcagtggctcagtctataatcccaagggagtggatctgggaggccaagatgggaggatcacttgaccccaggagttcaagtccagcctgggcaacatggtgagtccccatgtctacaaaaaatacaaagcttagtcaggcatggtgacatgtgcctgtagtctcagctacttgggaggctgaggcaagaggatctcttgagcctaggaggtcagggctgtagtcacctatgatcacaccactgcaccccagcttgggcagtggaatgagatcctgtctcaaaaaatatatatctctgttggactagagattgtaaataaatatataaggccaggtgtagtggctcacacctgtaatcccagcactttgagaggccaaggtgggcagatcatttgaggtcaggagtttggcactagcctggccaacatggtaaaaccccaattctactaaaagtacaaaaaattagctggcgtggtggcatgcgcctgtagtcccagctactcaggaggctgaggcaggagaattgcttgaacctgggaggtggaggttgcagtgagccgagattatgccactgcactctagcctgggcaacagagcgagaatccgtctcaaaaaaaattaattaattaattaaaatataataaaaatgaagataccaattaatacatgtatgacgtacactggttaggtccgaaaagactggacagctggaaggggttgtgggggcttccaggtcataagcagattcaacgattttctgattctgaggcatggaaactcatgcctgtaatcgcagcactttgggaggctaaggtaggcagatagcttgagcccaggagttggggaccaacctgggcagcatagcaagaccccatccctatttttttttttttgaggcagagcctcactctgtcaccaggctgaagtgcagcggtgcaacctcagctcactacaacctctgcctcccaagttcaagcaattctcctgcctcagcctcccgagtagctgggattgcaggcatgtaccaccacaaccagctaatttttgtatttttagtagagacggggtttcaccatgttggccaggatggtctcgatctcctgaccttgtgatctgcctggctcggcctcccaaagtgctaggattacaggcgtgagccaccactcccagtcagaccctgtctctactcttaaaaaataaaaataaaaaagcaaggattttctgcttgccaatgggttattatctaaagacctgagatcaatagaaagggatgtctgggttactataaagggttgcatagaccaaggttttatcatgccgatgaagcctccaggtagcaggcttcagagagaatagattgcaaatatttcttatcagacttaaagactgacagactttgtgcatgactgacagactgttctgtcagtcttaaggtctctgttttgatggtaatactggtcagctgtgcctgaattccaaaagggggaagggtataatgaggcatgtctgacctccttccagtcatggcctgaactagtttttcaggttaactttggaatgcccttggccagaaggaggggtccattcagatggttggggggctgagactttcattttttgtttatagtaccgagtatatacccttgatgtgatgtgaggaaaatgatcttcctccccaaaactcataacctcagttcaatcatgagaaaaacatcagagaaatttcaatagagggacatcctataatataactgaccagtactcctcaaaactatcaaggtcacccaaaagaggaaaaatctgagaaactgtcacagtcaagagcatcctaaggggccaggagcagtggctcgcgcctgtaatcccagcactttgggaggctgaggcgggtggatcatgaggtcaagagttcaataccagcctggccagcatagtgaaaccccatatctactaaaaatacaaaaattagccgggcatggtggcatgcgcctatagtcccagctactcgggaggctgaagcaggagaattgcttgaatccgggaggcggaggttgcagtgagcccagatcacaccactgcattccagctttggcaatagagcaagtgtccatctcaaaaaaaaaaaaaaaaaagcagcctgaggggacgtgacaagtatattgttatgtggagccaggcatggtgactcacacctgtgatcgcagcactttgaaagaccgagatcagcagatcagttgagcccaggagtttgagactagcctgggaaacatggcaaaaccccatctctgcagacaatacaaaaattaactgggtatggtggcacacgtgtgtagtcacagctattcgggagggtaaagtaaaaggatcacttgatcctaggaggcaagaagagacaaaccaggttattaaatgacatgcataaaaatgaggtcaggcacagtggctcagcactttgggaggccgaggtgggcagatcacttcaggtcaggagttcgagaccagcctgaccaatatggtgaaaccccatctctactaaaaatacaaaaattagctgggcatggtggtgcatgcctgtaatcctagctactggtgaggcttaggcatgagaatcgcttgaacccgggaggcggaggttgcagtgagccaagaccatgccactgcactccagcctgagcaaaagagcaagactctgtctccaaaaaaaaaaaaaaaaagagagatgtatgaaaacaaaacaagggggtaaggacggcttagaaatcctgaagtcgctgacacgcccagataactagtgactatagttacacctgctaagatttgggtgcatggggcttggctttggttagctcccttggtcttatttcaccaaaggaagaaacctcccggttatgggcaccctatttactgctgtcacctgacaggatttgcagggtaattccccagaactagtatattgatccagattttctgtttttacccagaggtcactggttggttcacaggaataagcagggttaatttaaaatgtgggaaaaacttaaaaacaactaatgaaactggaatgtaatgtcaagtgtatgataagttttgaaacttaatttttctctctcctgttctcacttttgtcaaaaagagattatgataggactgagttgtttgcaaaataaactttagtcttatggttggcctgattatttgcataaagttcagccagaataattatttttactagggttttttaataggttttgatggaactcagttccacaaggaatctcagacaagactttttttttttcttttttttttttgagacggagtctcgctctgtcccccaggctggagtgcagtagcgcaatctcggctcactgcaagctccacctcccaggttcataccattctcctgcctcagcctcccaagtagctgggactacaggcgcccaccaccacgcctggctaattttttttgtattttttagtagagacagggtttcaccgtgttagccaggatggtctcgatctcctgacctcatgatccacctgcctcagcctcccaaagtgctgggattacaggtgtgagccatcgcgcctggcctttctgtgagaaaatttctttagagcaagagctctctctgtctccattcctggacaggaatataaaacctgcttgcttcttttttccccccctccaattgcatgttctttctttgccaccaatgcaaagtaggaaaaaaactcagttttccagtgacattagcacatttgaccctggcagttcaaaataggcattagcacctccattttctatatgaggaccccaaggctcccagagatgaagcacctctttgagtcagtcagaccaggagacgagagagcagggctctagtttcggctctgccaccagtttgcagtaccaccttagacacgtccctgcccctctctgggcctcagttctccacctgtaatatggtgggggtttgtgtattttctgagatggtctctgtgatcctgccttgcttgatgctatggcaacaaaagaattcaaacagccccttgctattgcctatcactggatcttgtttccctttggcctgactccaagagcaagcactgcttccttctgccctcccctcactcactcccctctgttcttcaggagacaatgcggccagcccctctcccctccaggcggctgggctttaggccagccagccaaatggcagctgggactcagatgaaagggccctcagaaggctgcttgtggcagagtgcccagcctagcccagcccaggcttggcagcctggggctcagctgtgccacgaggcatcctgtccacccgctcccatacaaggctccctctgtgagtcctgcagagaaggagacccctgccaacccacaaggaccctcttcccctccctctgctccatacctgcttgagaaatatgcaagtctgtagagaatggtccaggactacatcagattgatctgactgtgccaggcactttggagagctttatcccattgactcttcagaataacgctgatagcaagtaatggtttttttttttttttttttgagacagaatctcactctgtcacccagactctaggctggagtgcagtgtcactaacatagctaactgaagactcgacatcctggaatcaagcaaccctcctgccttagcctcccaagtagctgggattaccgctaacacccagctaattttttttacttttttgtagagatggtgtctcactatgttgcccagactggtctcaaacccctgagctcaagcaatctttctaccttggcctcccaaagtactgagattacaggtgtgagccaccatacctgcaatctctttttatttatttgtttattttttaaaatttattttattttttttgagacagggtcttgctctgttgcccaggctgcagtgcagtggtgtgatctcggctcactgcaacctccgcctccagagttcaagcaattctcctgcctcagcctctcgagtagctgggattataggcaccagccatcatgcctggctaatttttgtattttttttttttttagtagagatggggtttcaccatgttggccaggttggtctcaaactcctgatctctagcggtctgcccacctcggcctctcaaagtgctgggattataggcgtgagccacagcacccagcccgtaatccctttttagagaggaggaacacatatttgcctactgtgtgtcaatcatggcaccaggcactggggaaagagcagtgaaccaggggacaagagctaacctcaaggggcccattgtcagctgtaattgaataaccacagaaatgaatatctggtttcacagtgtgaccagtgctctgagaagaaagtggaagaaactatagatatggatagacatgctaaagagcccataggtaatggtggatcacagataatggtggctcacagataatggtgaaccaatgtgtcctccttccctttgggaagtcccccactccacccagggaattctttatttagaagcaagtcccctgaactctgggagcctcatattcttcagttcaaaaatgggagttttgatgcccctaccatttctgggaggaatctgggaggccctgtactgtcagtgccaggcacagggaggcactgggaggaagtatggctgggcttccttcaaaccactccacttgattgggtcccagccccagcaagctcctttctggagggagcaggcagccagagcttctggataaggttagaacctgctcagtttcagccttgactggaagaacagagagcctggctggaagccaggcatttccccagttcaccagctcttgggtcttttaaccccaaaaatgcctcttgcaaggcacaggagtcaagatgcccaggctaggaaatggtagtaaaaggtaacctttgtttcacaggcattatctcatttaatcttcacaacaaccctataaggaagactaaaggaagattaaaaccacccccattttccaggtgatgaaattgaagcttagaaagcctattttgctaaaccacgattcaaatccaggcattctggcttcaggaactgctctgttgtccacaccctgcccttccaggccaggacagtactgccctactcccagccttgccctctttcctccacatcttctctgggagaacataaagtgatctacttctttttttttttttttttttgagacagcatctcaatttgtcacccagtctggagtacagtggtgcaaagatggcttaatgcagcctcaacctctcaggctcaaccatgtcacccccaacaggtacagcaccatgcccagctaatttttaaattttttttatagagctgggggtctcactatgttgcccaagctggtctcaaactcctaggttcaaatcatcctcccaccttaggctcccaaagtgctcagattacaggcctatcccatgatgcccaaccatagtctacttcaaatctaccactaggctgctgtcagacctggggcctcagtgtcctcatctgcaaaatgaggagggaagagttgggcttgagtatggttaagatcccttccaactctatcagtctttgttctttctagcataagtggtgtcagcataagcccttgaaaggcatgaggtaccatttccattcttaggattagcccctagagcacacatgtgcaaagacactatgtgcacaagaatgttcgttgcgtcat

SEQ ID NO: 1118 - DNA, 67114 bp, Homo sapiens
ccgtaagatcaccctcctgatccatcactagttgccattctaatgatctatcaggaaaagatacctgccattgattcggtttccctggggtggactcacagtaatttatgaaccagccagagtgtcctctccttgcggacttaatacgcttaacagctaattacatctgtgtagggattacactttacattgtccagctttatgaaaacaaaccctgggcttcctcagattccgttaaatagctccttatctctaaggctgtgatccttatcagtgccatatgtttgagcacccgtgcagtttccaaatgactccacgaacgtcttctagggtctaattagtctacaggctgaaggacaggcctgaacagggtctcatcctgaactagaaaccagcaggccaaagccaagggggaagattcctccctgccttctatcctccataaaccagtcaaaggtcaagggtccagacccggatgaccacatgtcaattctactcacaaggtgaccagcatgtccgatgtcaaccttcatacaatgtggagcttgggtgctcaagtcccagaggatcatgggatatctttagccaaagtcaaagtgaagtctttgtccttcccaaggatgctgtgggaggactattataatagtaacacttgtgtttaaaggataaacgtctttggctttttaacacaagctagctaaacccttccaacccccaaggaaacaagtcaatgctgctggcttccttttgccaccatggcaagggaggtctccgcagggaagccaatttgcctcacatactattttctcaaggcttgggagattcccaggcttggcagacactaaaaacactccttcccttggcttataacaattcagctaaagaccttgtcttaagaaactcatgcaaggaggtgatgcagagtgcaaagatcaggaaatgtctccctgtgtgaagagcccgtagcagaggggcaggctgtagctttccagcctgtgactcacagagtcacttccctgcttcccccatcctggactcagctccttggccactgtgtctcagctcctcttcctgtctccattccgcccagacccctgaacaaagcagaagtctggagtccacggcaaagactgaagtgttgtgtatatatttgggcgtcatctgtggaagcagctattttgaaaacaaaaaataactttcctgccctcagaagaacttggtgggctcttagaagtgtctcatttaactgtttgagacagaaaacttggttatcactcattggaaaaagagaggcagacagagtgcattcattttcattgatctgtaataataggtaaggtggccccttgagttggcctggtggataattgctctgctctagagccaaatggccctgggtttgattccccacttgtgtgccctagtcttctcatcagcgaagtggagaaaacacattttcctcatagaattatagcagaattgacatcttcaccacagtgattttgcctgggcactgtggctcacgcctataatcccagcactttgagaggccaaggaggatcacttgaggcctgggcaacatagcaagatcccatctctacaaaaaaaaaaaaaaagtaaggcatttattgcttattatatgccaggcactgtcctaagtgctttacatacagtattttattgaatcctcacaacaaccttgtaaggtgtgttctattattatctccactttattaatgaggaaactgaggctctgagaggttgagtaagttgcacatgatcacacagccactaaatggtggattcaaacacaggtctgtctcacttgagagcccagctgcttggtgtccaatatgctgatgtaaaagggaacttgaacttggaggtcccctggtccaaatgcctccctgagtccttaactcctggcaacttcttgactccttcccaacagccttacagagcaacatcctcttactccagaatgggaagaacctgaaagacataaaggaaagggcatgtgattgggaatcagatgacccagggtctactattctcatggtttctatccgttgtctaactttgccctttgggaagacaaaaaaacccagaatgctttccttgaaaacctcttcatatattgaaagagagcccttgccctcaaatcttcccctgtctacttccagcttcccaaccattctttctgtaagaccaccccgatcagcctctaccaggtatgctgcagcttgtcaagttaacccttaaatgtgagcacgagcattgagggtcagaatccaagggggtctgaccagtttgtagacaacaggataactcactttcttgtctctacttgtttatctagttatacagttgaaaatttcctttgcttctttggaaacccaatcatattctgaaaacacattcaacaaaagtccctaagtacttttgttcttgctggtgtcaaggagggcagcttaaaggcactaaaaatcaatttgctgagagtcaactagctaaaattctattcaccaaatggccaattttatcattgcattccacagctatttatttagggcctactattgtcaggcactgttctaggtgctgggcataaagcagtcaacacaatagacaaaaactttctagaatttctctggccacttttgagtttttctgattcctttggaatatcattttaaattttttcaatatttggacatttttaccattctttaccattcattttcaagtcattgaaaatgataaaatatatttatgaaaggtttaagcctgcattcctcaacttttggaaaattgaaacttccatagatcctgctatgaaggcagagtgaaaatcaatccataaaaacttcatagaaaccctcaagttgctataaactttataaataatactgaagaatgttggtttattgatcaatttaatttgatgagttagtcagtaggcaaattgttcatttgacaacctgacctttagtaaattgatcactggctaattgatttttggcaaactgacataactaattagcaaactaaccaacttaaacctgttgctaagcctggtgtcccactccaaaattggtgcagaaatatcaaataaatttatttgatgcagcctttgaatcctgaccagtgagctctttctgagtcttgactgttatacttcagcctccccaggcacctgtcacccagcaatttattcttcatgatatgaaagtctttgtgcagatctttaaaccaaaggaaccaagaagagcagtacatttctttgaaggcctccatgcagtttgttgagggcaggttaactgacaatctttgagaactgtctttcaacaaggtatgtctaccacactacgctaccgctagcatcatcacatgaatataaaaatagctaagctttcttgaatgcttgccacatttgaagtagtgtgctacctgctttacacacatctcatttaatcttcatccagatgaggaacataagacacagataggttaagtaacttgctcaagaccacatagctagtgagtaacacactctttcctctggaagttagatgtttattacaacgctgagcttttgtgtttagtcattgcttagtggaattatcccataggtaaagctaccttaaagaagggaatgttgaagccaagacatactgactaagacacttaaaggtccaggtcaccttaatatgtacctgtcatttggctgattgatttattataggatgagtcagctcactgcctgccatcaagagagatctcatcctggcttttatctcaagtaagaacatgtcccccatgtcttcagtagactggattcaatgctggtatatgtgacctttcatactgaggcttcaagccttaactgcccatcttcacttgtaacatggtgataacagcacctaatgcaagggcctttgcaaggatttaatgagataatatatgaggctcgatgcctggcatgtggcagatgatcaatagcagttctccacccttctagctgctcatgtctgagtgactgcagagctacttagatgcctatcaccatgaaatagagagaaataatgcaaattaagtacattatatatatttatttttaaattctattatgctgtgattaaacttgctccagcatatctgttgtccaaaattaatgctcactggtattttttttaagtgagcattattaactaattttgtaagagccaacttacgaatggattctggcataacattttgctcctctgtcaaagaagcaataagccttcctccagtacaaagggtcacaggaaaaaaagctggaccaaactctgaaattcactgatgaataagaagataagagaagaatgaggatgcttttttctctcttcatgacagatcttcaaggtaatttgccaaccatattagacagaggagcaggggaacagcacagcaatacatcatgatctatccacaatgattgaattgagggaaaattcatttctgttgactcaagtacaggctgctgaaaagattctcaaggtgatttatacagaagtaccctttgcttggtgaaacaggtgtatttgtgaagtgttgtgtgtgttgcttgataatgtttttgaaatccccaagaaaaaaatcattatatgaaacaatccttactgaataattcctagtaaaactaatgagatgatagaacgtattctttctgtactctgtatgttcatccattagaaaagtaaaaggcagcatgggcactgtggctcaagcctgtaatcccagcactttgggagggcgaggcggatggatcactagaggtcaggagttcaagaccagcctggccaaattggtgaaaccctgttctactaaaaatacaaaaattagctgggtatagtggcacacacctataatcccagctactcaggaggctgaggcaggagaattgcttgaacctggggggacggaggttgcagtgagctgagatcacactgctgtactccagcccaggtgacagagtgagaccctgtctcaaaaaaaaaaaaaaaagagtaaagtaaaatacagaacagtagtaaaaaggacaatatagcattgcttaacgattacaccaaagattccttccatgttgccattcagtccctgctaacacggagttcttccagagcaccaacacaatctcatcttgctttacaagtgaaatgcaaattttgcaacatgaggtgaaccagactaaataagcctaatttcctcagccttctgtaacagggttcttacctgggtttttcccatgagctccctgactctaaagtcagcttaggtgcctccatggtaaatctatgcattacgatacttaaagaggttcctgaactcagctctttacataagaatgactgaataaagaataactgagccaatagtgagaactatgctcaattcatcaaggtaagaccataaagatatgtagactgttctggaataagagtggccttcctcctctctgtggttctgctgataacccttaacccatgaacctaaggaaataattttgaccactgcctaataggttgtctggcacatagtaaatccttaacaaacacttgtggaaatcattaatgacactctttttgtgcatcctactctggcctacccacgtggtctacactgtgatacctacatcttgcttagggtcccaattacttaaatgagttcatattaaccaactctgtaaaataatgtctggcgcatttaagcacgttatagatgcaattaaatatgatcaaataaatatatataaattaaatattactcacttaatgtttagtattaagggctgaatctgaacgtgacacttggtttctacggaaggccttgcttttccccactatgtgttttgggatgtctgccagttttcttgttaacctggggagtgactatgagatattgatgttcactttctgtctagcttgagttctctgcctcgtatctgggttttcattccagttatgttctctctgtggcaatgaatggaatgttttcaatcccctttgtcaggataagttatttcagcttaaagagatctcccgtgcaaagcaccagaatctcgttaaacctctcctggtaaggtttgttcggagggctcctggtgagtcattccatgtctggatcctatgagctgcgcatagacccagagtcagacattgtgagagtacctttaactggaagaactcaacccacaaaaggacctttctacaaatacatgtgttttctaactaaaatctgaaatcatgaaaaatataggaaacaagctagtttagcattattgaaagtgttggtcctgcatgatgtgattaagaaaggataattttatgagttagtgaggcttgatggcatgcgtttctttgttcttattgtgctaaaggaaaataatgagttgatttccagagatatagctaaatgtggctgcaagtgtctagctattcatgtccctgcccatttattttctttagagataatcaaagctcttgtatacgtttgcaccaaacagtaaatatgtaatgaaaatttttttgaatcggtgtctttcctgaatttattcccccaaaatattatttcctgaagaaaggaaaagataaacagagcaaaaaatgaaataaagttagagtaaaaaccattttcttattctgtttttctattgcaatatctaaaagttgagagcttcaaacaattaagggatgagggtccactgtcaccagcttttggtaagtacgctgattctatgttctaaaatgcttggcataaacaacaggtgagtataaaataaaaaattaaaccacatattttcttttctttttttatttttaaacaaaaaaattcacaaaagtgctgaatttaacatctaggaggcattaagtaattacaggaaagtcatatgttgcgttataaagcaaataaaatctatggtgcaatttgatgtcttctcaataacattcacttgatatcaaccacagtttactgtaaaccttgtcttatcagtagtcttcattagaatactttttcctaactcagataactccccccttatctctgagttagacctctcctggggccagtatgttctactaccagaacttcaggtcaacttggctgttaatttctctccgggttgctcctcccagattctgccacttttctccatttcaatcaaaaacagggtaaaccgtattttaccattttaattttttagcacctaagagcagtctgtaacttttccaaaagttaaacttaaatttgctttcacaaaaacgctacagatttttaattatgcctaaatccttaaatggaagagattcatttaggaaacgcaatcttataaaaatgtgttagaaccccctttgagctgtgctcactgcatacccaagaatacatggacttgcccagtgcccctaagggaaaggcccatgcaaatgaggaaagatgtgtaagaacagctatttttttccaaagactttagctttctgggtttgcctgcattttatcatctgctgataaatatctgagtcaaaggtagaaagaaagacatgctgggggtacaggaaaattgggttaagtcagcaactagaaagctgtgggttgtggttttttgcttttcgtccttttgttgaagaggacaaaggaatgtgcattgataggaaaacctaatccggggtagtgaactgaaacccccccctccccacagctctcacctctcctgctggggtcgggggtgcagagaagaaggtgagtggagagagaaatggaagatgaggagacgagggtttaaagggagggagaaggacagaagtggatcaagggagagaaggagggagggcagaagccagagggagaaacagtagccccacctaaaacacaccaaaagcctccaaggaaagctttgaaaataagaccctgcaggaagcacttttagaaaccacagacttttcttcaatacaggggcaaatgaggagaaaaaaaaatgctaagaacaagaggcatggaagacagaaaagagaggaagaaggccaaacctcacctcctaatcattctgcctgaggtgctgaaagcatttcttaataaagtgtgaagtttcagctgaatccaaatttctggcattggaagcaatgccagagccacttatgaaaaagaaaatcttctctttttcttaaagtgaagaaaatcctgtgttttcctacaaggtcttctccatcccaaataacctagactcttccattcatttactgaaagagactgtaacaacaggaacagatgaggaactctctacaaggccagcctgacccacagtttaccagtgtctttcaggagaccctaatgttctcatccccaatctggaagtgccatccccaagaacacacaacagcaacagccccacccttcatcacaaagctgtgcagaacgtctcagtgacgtgctagttttgaacaatgatacaatagggttgttgccaaccacagggaaaacagggatatttaataaacagtgctgccatgattgataatctgcttgaaaaaaagaataaagttagactcctatttcactttgctccatatatgcaaataatcccaaatggatttaaatgcaataaaagaagaaaatttagaattgggggtttagaattggaaagaccttctctaataaaattttttaaaacctaggagccattttttaaaaatagggagaggcatatttgactagataaacatttcaaaatcttgtattaaaaaatcacaaaaaataaggtcacttatttgggccaataatttattaaataactccacctactgaatttgggtgatggtaatcattcaaaatggcaataatggatcttatgttctgactctgtaagtatagagtagaatattattagagactgtaaatctggtccatgcctccctgcactgccatgggtctgatcacttgtctcagggtctttcaccccctgagtttcatgattggctattctaacagatatggagttcactggagggccaaggaatcacatatctctgttttaacatctctaaagtgcttagaatataatatgaaaaagtgttggggggtgtgtgtggagggatgtgtgtgggagtgtggatgtgtgggggtggtgtgtggtgggtgtgtaggacgtgtatgggggaatgtgaggggggttgtgactgtggggggtgggttgtgtgtgggtgtgtgtggggtgtgggtgagtgcgggggtgttggatgtgtgggtgtgtggatgggtgtgtggggggtgggtgtgtgtgggggtgtgcatgtgggggggtgtgtgtatgtgggtgggtgtgggtgtgtgggtggatctgtgtgtgggtatgtgtgtgctggtgggtgtgtaggtgtgtgggggtgggtgtgactgtgagggggtgtgagtgtgagtatggggggttggatgtgtgggtgtgggggggctgggaggaggtgtgggtgttggggggtgtatgcgtggcgtgtgtgtgtgtgtgtgtgtgtgtgtgtgtgtgtgtgtgaattctttgtaatgaagaagaagagggaagaagcagttaaactttaaaccagacatacttatcctcaaaatagttgtggtgatattataccctcatactttgtactacaaatacatttattggtttgtaaaatatataatcagtttatgaaaatatcccttataagaagagtaagaaaaccagtaaaaatgtaaaacaaccacatggaaattatgtctgattccttcttctccattttattttatttttaccttttttctttgagatggaatctgaccatgttggccagactggtcttgaactcctgggctcaagcgatcctcccaccttggccccccaaagtgctgggtttttaggtgtcggccactgtgcccagccaccccctcttccattttagaaatgatgggtacagtaatgcaaccttgcaaagggattccttcaagtttttcaatgttctttaataaaatgacatcaattgctgaaagcattatgacctttgttatgctacataatactgatacaaaatgtgaatagtacaaagttcattatatataaggctttaatatattacatttgtttctacataaacagactataaatatatgtgccatagcatgtcttatagtcattgttcccagcatttcacactatggtaccaaacaaaaaacacattttcttttttgaaaaaaaggacagaacaagggcaaaaatcagtagaaatagctctatatgttaaaagtctaaataatacaatagatgttataatttgggctataaaataattttgaagtctggctaataatcattcagagagtgaacaaacccaatcaggtttactggagtagaggccaaataactaaaatactgatgggttgcggggtgagagtgggttggggacagggggaagaacaaaagggtaaaatccttcctgaaactttgacaccacacacagcttcacattgaacctcccgcattcagtctcagacatatcacatcaggacagatatgagggtattcattccagaagaaaccagaagctggtttgtgcagtcagaactcttcaacacggcagggagccttgagctgaatgtcctttctttgtggtattctgaataaaggatcagcctgggagacaaggagccagagctgcatcatttccttcctggggcttggccaggagacacgtaacggtctggaaggaactctcattaggagtcagaaacagcacaacgaactctactttagcccaactcgaagaacacgcaaccttctaaaaccagaaaccccgtctgaaccctttacatttcagaacagaccccatgcccacctccaccagagcaaacacaatgcatttgcaggctccagtactctccaaagcaaggtaacgttagtcttcctttctatcaatccgaattccacacttaaggcttggcttgggacccacgtcctaaacaaagcctcttggatagactcagccctgcaaatccttcccatcttcaacacctcgaacacttacattgcctggtttatcttctagttttacagaagtgtcagctccccaggtactgctacttctttgaggatggggccatttcttgaacgtctttgttctaaacccatggtgagacccgcagcagggggcatgataaatgctttttaaatgaatgaaaaagaggatcaggtcaacactgggagaagacacagacacattcttgggtcacaagcctcttccaggatatgcctagaagactggctccctgcagtccgaggtcctttttctgttgtcgaaatgaaaatcaaatgcggctacttcctgctggtggaaagaacaacacttgaaaatctgagcagcacctctcatgtgatgtccaggagttgggggtgtggatgcttccttttaaacaggaggagagctcagtgtggtccccgagtcaggctggagaatctgggctgtgctaccggtttgcactccaatctctatcagctttaaaagttctgcttcctcactggagtacacggtggtgtctgtgtcatcggagtgatatccggactggtagccgcttgtctggtttgagccttcagatgccacagactccctgcttttgctgggcaccattccactgcagaagaaatggcaaacaaaggagttggcagagagaagacaattcttttgctttttaccctcaccccattcccaactccatatggctgccatctccctggagaccgcagccccgtatctctcccagttgttaatcagcatagcaggtttacagggacaaggtctattttcaggtactcgcatgaattagtagttgcagataagtcctcttactcaggtccaagtctttcaagcctcaaatgagatgaaaggcagttctctcgagttatgcaaaggccccaactgatggaacatgtttatggcctcgcagattgacaaatttgtatacagtgacaggcgccaaagggccacttgcatgatattcaaggaaattgggatgttcttaaatttcacttgtgcttttcctattgtggcaatttgggaattacggggcatgtgtatggttgtaataaagctcttgagcaactttaaactttaataacttgaagcatgtgtgcagtcaagccagacatatcaaacgctgctttttactcatcaaaaccacattccttggaaggactgagaacccctgtcactcagcagcaactagaaaatgttttcaatggcatggaatcctgacagacggtaatcatgtcaaagcctagaaatgcaggctgtgttgatctaaaacttcaggatttacactttcacaagccattctaaggtgttttttcccggtaataggtgttttccccaacttcttcatgttaaaactgcaaaagggaattttagtaactcgtgtttatacatagtttaaaagttacttcaaataatgagaaatacaattttttctttcaattcaaccccaacaaaactaatgtaggtgtctcaagcaatggcatggtgctctgcacatgatacttgccgaataaacattttttgaatcaatgaatgaaacatatcattgactttcacaatttcttaccttgggccttaaagaaaacaataaaatagcacaatggcaccttttaatatgttggggttttttttgtttgttttctttttggtatgagcattattcaaaaacccatgagtattcccattttatataaaagattataagcagatcaaaacctcctctattcttacctttaggtaagaatactctagcaaataaactccagcaaatacataactacacttattctattattcttataaatatagattttcattgatttgttatgttaagagaacgtacacgtattcaagacacctacaaattcctactgagccatagaagggagattatatttaaaactaattttaatacttttctcacaatgaaatacttcgaattcagacaataatatttaaatgtctcaaacaaatagatattggcttatttatatatcatacttcttaagcacagatgcacccatttgtatacagacttaaaaattcttcagagtccacaaagattgtaatcatattgacagctttacggatcacatccaatcacctttttcatttagccattactgaccacagtaaatatacacagaaattccctagtattcatgaattctcataaaaattgaccaaattctctaatttatttcagattatttttagatttatcacttaattttattgtgtggttagtttccattctttatttgttaaattgatgctaatttctccaaccaacaaagaccccatagggaaaattctgcacttacactgaaagtcctaagttccttccaaaaattcctattgaaatttgtctttttaatatggctgagtcttacccaaaagatggagataatttggttctgtcttccaaagttttcagctcttctgaggcaagaaccataccactgtccgtctggttgtcctttttaagagacaatgagatggcacagttaattgagcatataaaatgaccaactatttaattaagctgatttctcaacccatctatcatgtctatcaaataaggtcctgtggaagaacataaaggtatcatagccacaaattgtccaagctacaaaaggaagcaactgcttcctatgagtagacacaggccagggagaagagaaaatttacaaatcagcagctgagaatgcctgttaccatcgctgtcttcactatgacactacttgcactttagtgaaattggtcagaaagctacactgtcttgaaccttggaccaagggctttacttatgaaaaaaacaaagttccatctccataatgaccccatgatacacacactcgagggcagccttctaatgaggctccaaaactttaatgcttaggctaatatttatctagctagtgtttcatcctttgtattatttctaagactatttttaaaagacgtacttacatctgggattacttttacttctggttcttctaacgggatatcttcaaatgtttttacactcacaggccggctctttcgcttactgttctgcagatactgactgcaaaagaacaaatatttatattttagtggtggtatatttgactgcagatcggctacctaagttcattatctttcaaccacaaacttaatagcaaccttcaaaacatcctttagaaaaacaaaacaaaataaaaatctttctctgctagcacacatggaaggcttaatttcctgagaaagtacatttaaaagtataatataactgaggagtctcgatgagcctgttcttttgaatcctacttctgaggtccagttctggactaaagacaacaacagcagatggagtgatcaactgccttctacttggcttcctgattgcatgggattcctccatcgagctctggatatattactgagtgtttcacatctgtctggccatctcctgggaaagtttttctggataatgctcacagagcaaccattcaatgaaagataggcagaggaaacatctgaaggtctccttaaaggatactgaacccagcagtgatttgaagacaacctcttcctcctccatgtaacagaggcttggtgtgcaaagagaaggtgggctgagtctcactgtcccctcgttttcgcccccagagttgctgtctcaggaaagagcagtggtttgagaataacaagatattttgcctatttcagagtctaccactgactgcagaaacttgagaaagtcatgaatatttctgtgaccctcttgtcccatctataagatgtgttggcagtagcactccctccccagctcacagggatgttgggaagatgaatgacatagagaatgttgggcttattgctcttaggaagaataatgccctcttcaaacaaagctcatttttctcctttgacttccaaagcttccttcaggagtccaaagaataagacttgttgaacaacagatcctctccttcttgagaatgctccttcccggccgtgtggctttgggtgagtctagttgatgctatcaaaatcacttacagcccaagtggagggaagggaagtcctattcactggaagggcccaccgagacagaaaatacattcttcattcctataccagcctacttcccactacaagcagacttctggaacatgctgcatagaccttgggccaaaggagaagaatggaaattaattctctctcccctaccccaagaggctggttcctccctatagagagaggagagaatgagattttccggtgacatcctcactcaggaaactccacaagttaagaggatatgatacacagggtgcaagcaaagcctactttctaagtccaacccctaaaagtaacagttgtcaaacactactggtaccgtagtcaatcattcctgcattcacttgttcaggaagccctcactgataatctgccgcaagcctgacactgtgccagaagctgtctaagcagcatctcatgatgtgttcaccacggtacctctctaggggtgagtattactatcccaactcttcagatgaggaaaccaaggcatagaaaatttgaggaacttatccaaaatcacataactggaatgtttggattattattttgagggcaatgaagagccactgaaggattttaggcatgggattgacaagatcagatatgccctttagagaattgactctggattgaaaagaataagactagaggcataagacccaagagacaaatactgcacttcttcaggagaaagaaaggcagcttggctagaaaaagggaatgcccatgaggtttggagacatgggctcattctagagatatctaggggatagaatcaactagggttggcgagtttggacaataattcagctgccttagaaaggacagctccttaaattcttaatccagtaattttttaaatggcatgatcctctcatgattgacaaagcattttcacagacaatggtgcatctgtttctcctaagacggagaaacaggtcttttaactatttcccctttggagatgagggagtcaaggattagggagaaaatggctaataaaaggtagaactgggactcaaacttaggccttcagacactaaagcccatgtgaagtttttgttttgttttactctactccatacagactcccttggaagagtatcaggagggaaaagaaagaagaaaacagcagacacaattgttcaagccattattaagcacccagtatgtgcacagcactgttctcttgtcatgcatgcactgatcatgcagtagcagggtcaggggtgtaagtacggggtatgaaacagacaaaaagtgcagaaaggacagtcccactgcaaacagtctaatggtagagccaaactcaggaatacctagctagcaggctgccccaagcatcaatctacaagggccatttaatcatccctaacaattacaaaatgaagaaaatggtatgtaccaaaacctttctctaagagagaactgcaaagaaatttttgataagctgcttgatgtgtgaggtgaaactcccagggaaaatgacagagcaattgccgatggtccccaaactgccctcaaagaaagatgagcccagcaagtatgtgttttcttgcaggaagcatgcaaacttgaggccagagctggtccacaggggaaattagaggcaaagctaagtctagacatgagtggtccctcccccacacacttctcagccttttctctaaataaatgctaagtaaatatttttcaaatggtttaaaggggcaacaaatcatgaagctagctcccacagtgatatctctgtccaactctatttataatgcaatagaattgaaaattagaaggagaaagactgctcagcttttgtacttggccagaaatgcgtaagaggatagaacaagctccctgagaagtaccccagcctcaactcattctccccagagaaacagaaccccaggagagcaacagaatgaagcatgccgtgtgcaaatgcctctatctgcttttcttcaaaaccagatgattaaaatgtgaccgtgagttttattttatagaaaggaaaaaaggtggaggaggtggagaggagatgcagacaaaagattccaatttccattttatttttcaaattatggctggataaaagagaaactgggctggaaaaaccaattcaaaaatcacagacagaaaataggagccaggcctgtgctgggagtgtggtgtcacatttgtccacgcttctggggataaacgttagcagcccttctatatatccaacatcgtatttggtgcttccattacacaaacatgatttcttctcctgctcagcaccatatgcaaagcacccggtgagccaggaggctgccgactcggatcatcactctacttggtcacagaaaacacatggaatgtagttcatgatcaaatggctttctgataaagggggaggcaataatggtgtgtgggaacaactgtcacactaaaaggccagctcaacttgaactggaaatgtgtaaacacaggagtggaattgtagtctcatctcattactgtttctctctgagggccctccttggcatgggaggaaacaacatggacttaggggtcagaggaactggattcatctcaaggatgtgattttaagcagctcacttaataggtatcttttactgagtgctttcaagggccaggtgcttagaaatagattatatcttataactctcaaaacagccattttcaaacagcaccactgaccttgtctcatttcacagataaagaaactgaggcagagggtagatgatttgccccaagttgcacagctgctacaagacagacttgggggtcctactcatttctatctgactctaatacctgatctttaactacaagtttgtactgccctcaggtaatagaactgagcctcatgttcaataatacatcaaaaaaaaagatcattgtttctaccttgcctgactctgagtgtcatgatgtgggcaacatctgataatatacggcaaagttctttaaaaatatgcctaatgcttttgacttcaatggaacggtcagctgtcttgctggcttctaagctttcttccttcccatcagtgtttctgctgccccacacgactctagagggcaaactgtccacgagtttctccttagcatcccctgccatgtggcaacctggccaagttctggacatgagagagctccctgcccctccctgcagcccaggcacactcgggctggcaggctggacccatgctgtcaggggttccattaaagcaggaaaacacccaaacgggttaggaaagaaacaaagcaaaatgaagtagtcccagccttagtaaagggcaattttaatatcatattgtagaaaaccacaccaactctttccttatgcacaggtgctgggagagagaaaaaagaaagctgcctttagaacccctctgcaaatcaggaaaggactgcagtgcatgtgttttaaataagcccagacatcccattatgcaaataaaatgctgaaaatcagacgtgggaggggcttctgagatgcagtgtccagtctaattccggacacagacccatggctttctgtatccttgccagagagccataagcatgttctcatgcaagcacagaactcttcctttctgaatctctcctaagccatttaattcacattaataaaagcatacacggggataatttaaatgcagatgtctttgtaaaactcgtctctttattctggaaattagcaaactgtggcattccagctattgcagctgcagggcttggaattcttaaaggcaatgctgtggcagcagcgtgggctacagatgggaggaagcacacctacccaggccctcttccaggagcattccccattatgttaacctcagggctaaggttatgtggaagtgggatgcaacagccttagacaaggtcttccttccacttccaatccccctcccgagatggccttgaagtcaccctcccccgggggatgttaggccatatacagtacctgattcctgctgtgttgtcataatggaatttggggtcacatacttcctcctcctccatacaggaaacaggtgaggtaggcagagagagtccagaatcctcttccatgctcaaagtctctgatatcggaagaacaatgtagtctttgccatcctgaaacaataaacacagaagactgttgttatggcttcagttcttcaagtgccttttcattaaaaacaaagggcacagggacttcttggctacatagggtgtgtggctttcatatctgaacatagaactttaagacaacaatacaaatcatgtgtcagaaacaaaaagctgttgaaatggaaggtatattaaaggagagaactaaaaacaagatgggtaagcagcccacagggaagtgcagttacaatgaagagaaagcaggctgtggtcagagaggtaacaacagaacacaaggagctacatagaacaaaaaatcactcattcacaaagccctaaccacacgagccaagcccttcaaagggcatggcatccagttttagccaccacatttcaaggcaatggaaaaactgatgacagtctaaagaaaagcaacaaatgggtaggaaaatgggtcttttgagaaaaggttgcacaacttaatattattgcatcaagaaaaagaaataaagggctatttgatatctgtaaatgtttggaaggtttattgataaaaatagagctgacctatcgtcccccagctgttcaaaagaaaagaaagaggaaattcacttccattgtagtaagaggcattgactagagattaaataacattctaatagtaaacactacaactctaaaatcttccagtggaagttataagaacctgggatgataccaagacagaaaccatctcttttgcatagcttagatgtatttttgcctgcagaatttattaaaaatttcttgaaatttcttccattgttgatcttctgtggatcaaccagattttttctttgttttaactttagaagaggatttgaaaatataacaaaaagataagtaggtagaaatcagagtggtctgctcccgggttataaattagaatcctatctgtctaaaagggtaattacagcttttagaaaagcattattactcagatgtagaagaatacagtagattattcaatggctgagaggatggcatggtagccatgagacagttcaggcagtaggaaagtccttgacatctaagtactctttgtaggtgcttcttggatggaggtgacaaacctgctgagcattagcttgcaagagatttcccaaatgttccaccaactctgaaaacgtgggtctctgactgggctccccgtgccagcagtccagcatggtctggtacctagagaagcaaaacactgatttcattaaatgcctctttcttcctgaatgctgaaaataagcacttaaatgagtacacatttgtaaagagctgacgaggtgagatgctaaataaggatacaaaactgtgtaagacacagagtcccatactccagaggctcaatgtgtatagaaaacatttaaagcaacatctaataaaaactaactggttgctttgaataataaagtactatcttttcaagaagtgatgactccatgcttgaaattatcaagaaaggccccaaagtaaaagcaggacactaactgggcaatgaagaaggtctatataatggaaagtcttccaggcaaggagaatttgcgagcaaagaaagagaacacaggaatacttcttaaagtcttacatttctggtgtagtataatcaggggccctcattctagttccttctttcaatcgcctacaaaattcttcatcaatctttaccccaggatatggagaagcacctagaataaaacagggaggagacattctttgatttgattttctcttatagaaaaccctgagcctgaatcttgcacatcctcatcacctatgtatctattttttttttcaaagcttccgagaagttttgcctgatagacatgaagtacaggagaggaaaagacaacttttgtcttcctctttggagtctggatggaaggacaaaaagaaatgacttacctaaggaaaatatttcccacagcaaaacaccaaaagaccagacgtcactctggattgtgtacactctgtcaaaaattgtttctggggccatccatttcaaagggaggcgagcctacaggggtagaagacaaggattcagaacccaaattagcaaatatctgaagaaaaaaacttcctctgttcctgaacacaggtcctgaagctctctacgaggagttttaattctgttacttaaccaagcactgggttcatatttgaaacttacatctccttttctgacataatctggatctttataaatatcccgggccaagccaaagtcacagattttaaccacgttcttctccgataagaggatatttcgtgccgccaggtccctgtggatacactgcaaagagaatcatgtgtgcattaggtctcggcacagctgatctctttcacatctgttgtgacctcatgcatcaaaaaaaaatcccacatcagaaagccaactgattaacaaggactgggttagtatcttttatcaacacttcaggaaaaaagtctgtgagctttgctgagacacacatctgcttattccataaacagccccagcctttggagttaaataattaagttataatatgatgatggaatcataaataggctcctctaggacacaaaagagtgtgtttctggtcacatccacacattccttttacctggccccatatttggtttaaaacgtgttattctaaggaggtccgagaacgggatttgttttttgaatgaatgcacggaaatcagaaacaaggggctctcattggtttagtgctctttgttggtttcccccttccgtatgaagctgaagccagactggctctgataaacaattcccaatgtggcttcccctgatttcaaagtgctgggttattataaaggtctattaaggcaatttcagcctatcacaagtcaggttgattttctagtgcattaatagtacaatgagattcatcttgacttctttctcttccttttagcttctcagtttctcctttctctgtatcctccaaacttcagctaacttcctactactcggcagctttagctccacatgatattttgtaagaaaatgagtcttggggagcacaagaaatgaatcaatggcttagaagaaaactttttttttttttttttttttttttgagaaggaatctcactctcgcccaggctggagtgcagtggtgcaatctcagttcactgcaaccttcacctcccaggttcaagtgattctcctgcctctgcctcccaagtagttgggaccacaggtgtgccaccacgcccagctaattattatatttttagtagagacggggtttcaccatggtggccaggctggtctcaaactcctgacctcaggtgatccacacaccttggcctcccaaagtgctggaattacaggcatgagccaacacacctggccaaaaggagaattcttaaatcattggagaagtgatcatgtaagccaggcattgctgaccttcccacacctcaaatctgtatggcactctcctctgaacaaggcatattcagaagcacattatctagcacaattgagcaacactggcaattccaaaaaacagacagtgtttttgacttttccccccaaacaaaaagtttccttttttaacccgacaaccaagtggattcaagaaatagtctggtagatgtaaggaaagttaaagcattcccacattcatttccattctcttcctagtccccaaaaggaaccctgactaagtggcgaattccggccataaaaaaatggtaataataagtcataatctccaagaagtgtaaagggcctttctctttgggaaaaccctataaggtcccagttctcctccttccccttgggagagagaacataagagctacctagcagaaacatcaaagagcctgaggcctttaatgctatgagaaggggaaaacatgggttgaagatttcattctaatttaggaaaaacaaaaaaaaatatgacttaagtctttctttcttcattaagctgcatgaatacattctgtcaactgatagttcttcctgatccttaatttgaagtattgttacctaatataaaattacaccttttatcctttccaggggaatcactgccaccagccttgctccccgcttggtgtttacaacctttggaatagttgtaacttgtcacgtccccatctcagcctttgtttggcctacttttctaattttagctcttttaatcgctctcatctgaagcctgtccttcctcgtttctaattatactcctaacaaatactttttgatggatgttgatgaatgtaaaataaattaaaaatgattctcatgccaagatatctgtaaggctcagcccctcccctttccaggtcattgctcaaatgtcaagttcttagtaaagccttcctcgtctaccttgtttaaagtagatgtacacacacagagaagcataaacatacacaagtgcattgctcctgtgtattctataaccctttcttgctttatttccccatagcatttactctcatctaacctacaacacgttttacttgtttatattgcttattgtttgctctacccactagaactgtaaactccatgaaggtgaagagctttgcctgattgttcaccacagtatcctcagtgctcagaagactgcctcacacttagtagatgcttgacaagcctttattatacagcttaatttcatgaactccttaaccactcttactcagcagaaacagagcctccccagtagagctcttctaaaagacgtagaagtggtgaatgaattacaatcccaaacaagcaccaatggctgacactggacatcttatttccaaacctgtgatctgaaaagatagctgatttcccctcaacctttcttacctttcgcgatgccaagaactccatgcccttagccacttggaagctgtaacagatgagatgctccaaggtcaggaagtccttatacagatcttcaggagctgtccaaagaggcaggaggatggagatcagtatttccatgagttagtgtgatgtttctaagtttgctagagtaataatctttttaagacttgggagttaagtttttaggaaatagaagcagagagtcaatgcttctatcttctgtaaatctcctgaatcccagtatcattagccttcatcatacccccttaggaacaatactggtttttccattttagccaaattgaaccagtaaatccaggaggtagaataaggtaacactgacctagataatctgggaaataaagaggacatttccaaatttgccacttacactgttttttgtcatgtacccagagggataaacaatagtttcatatcaagaactctaaaaataaaacaacaatattcagggtcattgaatctcttctctccaggttttgtcctgggacaaaggccaaaagtcaaactataatctgcaatagataactaaaaatactagaaatatatttaattcattttcaaacttaaaaagtgctgtaaatacattaaatctggcctgggagggtgttttttcctgagagataacagaaacatggaaagataaatttacgtaaattggtggtatttacttcagtgcaactggtacaaataaacactaagatattaaatgggtgtttcaaaatcatctctttggtcagataagacttatggcttctttcctggagacaaataccagagtaaacaaaaacttagttgtagtaataaattcgtaagtatttaaaaggctgtgagcctttttctcaacaactcaatctcttaggtttctggctcactggccactgttttttgaaagacaaagagcagggtagaggcagcaccactcagtgtgggcccagctaaatgaagcctagaccacctccccatgtgcttctagaccaagtcccagcctcacactaccttctcagcttctaaggaaaaggagttaaatgcaaattctctctgtagcctcatgtcaagggaaacagagtgggtttcttccactattcttctagacttatgcctcaaggggagccagcctgtcacccatctctacatccacaacgctatctctgctccttctgaaggaggcagaaatacagtgtgtcctggagccggctgaagtcctggaagttaggctgggaccacagctccacccaaaaagagcactaaaatatcactcaggccaggcacggaggcttacgcctataatcccagcactttgggaggctgaggcaggcggatcacctgagatcaggagttcgagaccagcctggccaacatggtgaaaccccatctttactaaaaatacaaaaaaaaaaaaaattagctgggcatggtggaaggcacctgtaatcccagctactcggaaggctgaggcacaagaatcacttgaacccaaaaggcgaaggtttcagtgagccgagatcgcaccattgcactccagcctgggcaacagcatgagactccacctcaaaaaaataaaaataaacataaaaacaaataaataaaatatcactggaaacataacttaataaaggccaggatatttatcaagactcgcctgaggaagtatggttggaaggaagacttgataagccgcttggggtagggtagaaacaacagatggctcctaaactgcctttgagaaggttaggtataatgaaaagacttttgcacaggtaaagcatgcaacgtggggcaaaccactctggggctctccaaggcaatggagaggctagtcaactaccagaaaacttgtggcctctctcactaataaatgctgaaccagtattttaagaacactgctgtggttgtagccgactgcttagcccacttggactacccagatttctcaggctagccctgcttcacttcccagtctagggcttccacacttcacttttggggagacagaatggaggcagtctattatagaaattcaggtctctttcaaattatgaggtagtattggacttttcccatgatcaaattccttgtaacaccctatcaccctgtctgctctgacaagagcatgccatagcatgcaggaagcactagccagtaccttcctcttcttctacatcactgagggacttctcctccacaaatccagagctggctgagctctggctactggtgatgctgtccaagcgccgtttcagatccacagggattgctccaacgtagtctttcccttgacggaatcgtgcccctttggtctataaaaaagcaaaggaacaaacaaactccttgaatacaaaatgagtctttaaaagtttacaacctttaaaatgtagtaaaccatggagataattgaaactactaaaaagcagacaaggaggacatcaatttcaggattatgcaatctctgagctgaaacttggggcaagttttgtgcataatagggtttcttccacaaagcctagctccttctttagcttaaagtgacaaatgccacattttgagttgcattcagacacactttcagcattaggatgctcttcacagagggatttacactccacggggccaaatatggctaggggagagacagaataacccagagatgtcctaccctctgccctcccctttcctcgctcatacctgccttctcccccatgtccacactctgtaatgggtcagtagattaaaatcacatacataaaacagaaacatatggcccccagaaggtaaaagaggaagttacaacagccaagaggtaatatgagaagattcctcacaagttcttcacaaaatttcaactaaaaaactaacctgtaccattttgagtttcccttcattttataacatggccagagcaggattaggagatgacataccttgtaggggacaaattcatttctcttgctcctcaggtaagtggacaggtttccaaatttgcagaattccacaatcaccatgagtggccctgcaggcagcatgtccaggaaggaaaatgggttttcactcatattcctcactaagcgtttaatatagtgatgaacccaaaaacaccttagaagaaggctacaacctttcattgggacaggagtgtagaaatcagctggtcccaatccccttatattgtagcttttcttttttccagaacacattttcacaagattaaccaaaatttcagaagaaaacccacccatctacttgcttttcagtgcaatctcctgatatgattccattttgggggtaactacccttaagctttcaagttttagggaagtttactcttctctggacatctgttacacaagtaacaaactgtatcatagtagcatgacatttcttaattcagagaaagttttacaataatttaattctagtgccaattaaacctccatgaaatatatttattcctaggaatccgcaaagtattctaagctaagaaaatcaaggccagaggagttgactgctttccctcaaacactatcagagaggcatgttaaaattgggtgaccaaaaccacccacagttactcacctcctggcttggtacaggcacctagaaggttgaccacattgagatggtgaccaatatgaatgaggatcttgagttcagacatgagagctcgatgctcactgtgtgttgctccttctacaaatacagtacaaagagggaaatcataggtatggacatttccttcaataattggggtccctccctccctgcatgccactatacaacttaccctccggggtaacacagctgtgacctagtttacagaccacatgcatttcctcaaaagtgaagtgtaaattctattttctaatttgaaataaaattcatattttaagtgagccagaaagtttgatatttaaaggaacccattgtgaaaccttttgcaaagcggagaatacatctgcagtggaatcatgcccagattctcttcttctgcaaaactggatttttgcatttcaggttcactatgattctgagggtctgatcatttcagcacttcctcataaggaagcaacaccatgtattaaatatcttcacgtgttaggggctataccgaatgttccagccaatctgtgccgatctgtgcaggcgaattaaggccagctggaaagaccagttggcacatgaggctgatggcactaagactatgtgtttgatcctgtatggactgctacacttcccactaattcacaggcatggtccacatctaaggctctgatgagccacctcaaaattacacactcccttggccacaagagaaaaaaggcagatggagaaagatagctttgaaatgcacaaaacctattggcaaagggtcattggcactgccttcatcaatgaaagaacatcacaattgaagaaagaagctttactgtctaacctcctaaaatgaaaatggccagaccagaattccgttactattagaattaacaattatttataaagcttttaatttaaaaaatataacccattatatttttttctaacacaaccattcttgttttgcaaattatcttttacatatgaacatcttttacatattccaattctggagaacatgctatttttgtatttcactatcttcctttccatgtctctagatggtctataattatctgattccacaatatattaagaaacaattttaatataaccacagtcctttttccctgtacccagaaccactaagtacaactgtgttggctgagccctgcacgagggtaaccaggcaagaaggtgaaagccattcccaactttgcttgccagaccatgcatcctggcataaagctacaaaggaggatcctttttccaatttgcacaagggcattatttaggctgactgcatgtgtggctagtaggcccacataagcacaaagctactgatacaagccttgcaacatatttaaagactagataaaacagaaagatagatcaccacataattttgcttttacctttcaacattttgactgctactgtcctgcaagttgctgtcttgtcaattccaaaggcatctgcttcaatcacttggccaaaggcaccacggccaagaggcttacctagagtcaacaacaacagcaacaagaaaacagacttggattactatacaaccaaagtgatacgcagagacatcaactagatagggtgaccatacatcccaatttaacatggatagtccagtttactcctttgtcctggcttaattatttaataactcccccttcactctccaaatgtcctgctttggatgattacatagggaccctacctctaagtggctatatgaatgattatacaaattcaagaaatggaattaatatttctaaaccagaatccaacatctgaatacaccacatttgtcatcattctaatggaggaagagatggcctggtaaacacaatatcaaattaatagcaattgaaaatgcacctagcttcagccggtctctggggaattcccatttgctggcatcataaggcagtcgttcacaatgttcatccaatgggagttcatctggatccatgacgatggacaagtagcctgtcttcagttcccctccattggcctggaaagcatcaatccttccagtcataaacacactgttgtttggctgttgttttgtgtgcttgttattgctgtttattggagcctcattcctgtctcattttccaataaaactcatggagtttgagagtggtcctattataaccctgcttctagtttcccttgtcccccaaaggagctcagaattaaggttttaaagcttaattacactagacagtccaagcccttttcctctctagtggcttctatcaattaaatccctgagatccagccaaaagaaagtgggcaggaacgttattgtattgaaataaaaatgtgcccattgagccaataacaatgggaagaaacaactcaaagaaccccagtcagttttcattaatcatgaaaaccaatgtgcatgggcagaagggaaattatttttttacccgcttaacggtccgtaggatgatgacaagaagtagccagaagaacatggcaatcaccgccgtgcctactagaataatgatttccaagttcgtcttttcctgggcacctggaaagacacaattgaatgagtatcaacagttggaaacttatactttttgtttgtaagatgacaaattttagcactaaagcaaaatcccaagcttaccaacttggaaaaatcctagaggacaacagttacacacccgtaacttgaatggagtctacagaattctttttttgaatttaatttatttatttatttatttatttatttatttatttatttatttatttttagagacagggtttctttctatgttccaggctggagtaccatgacacaatcatagcttattgcagcctccaattcctaggctcaagcgattctcccccctcagcctcccgagtagctgggactacaggtgcataccaccaagcccagctaatttttcttttattttctgtagagacagggtctcactacattgcccaggctagtctcgaactcctggcctctagccatcccccctgccttggcctcccaaagtgcagggattacaggcataagccaccacacctggcctacagaattgttaatggaaaatttaaagcttgcaaaacattgctcatgtaaacttacaacaataaaattcttaagtaattaagcatagaagtagtaatgtcttaaaagccaaacatagaaagtgtttagaggaagagcagtctttgatggaaagaaaacagatcattctctacagagaaaaaaaaatatttctatttgaggaaaacaaaagtcttcttttaaactgatagtcaatattttgatctgtgcagagtttgcaaaaggatcacataagaaaccaagtagggaaataaacaaaattttttgacctgagagttactaatgaccatgtatctactatgcactcatcactttaaatatgccattccacttaatctcctcaacaactctcagttttcagatgaagaaacagaagaccagagagcttaagctacttgactgagggcacacagctagtcagtggttcagtcaagagataaagaggcctgtccaacatgaactaaccattacatacactaccccatcccttgtggcaggagtctgagtgaggagaagaggaagagccaagatgagcacatcacgcatggcctggtaatgggagtttcaaatcactcatgaaaggaaagagaagaggaaactagaagtcagcaagcaaagctgcagatgctcagggcttcagaggacagctctgagtggaagaaacaaaatacagaaacaggctttccactaagagtgattagcaaagagatgataaggaagcagtcatcacttggggcctcccatcagaagagtgcaaggagaatcaaaccgggccacaagctgtgcggatggcccactacggcctcaagagagaagaagacaagtaagaaactggtttgcaaaataagtaacaaattggtttgcaaaataaaagttaacttaaccattgagagacaagcacaattatgcttggagtaaattttgtttctctggtggtcctagggaagtaattctctatttatacacacagatttaaaagtccagttgaacatagaggataaaaagttcaaagagtctgttttctatgtgtttgtatattaatattctcgcataacatttgggaacccagcaggagtattaaatatctagctctgcctttcttagcattcactccaggtaagaagtaactataatctctgtgccagtgttacctagttaggcatctgtaaccagctgcaggccaccaacaagaggtaatgcagagcatcagagacaatctagacgtcattctgcggatttgccctaaaacatgaatcactttggaaatgacaaaaccgccatggtctttgaaatctttatttgcaagtgtagtttatgaaatgctaataagcttatacatttgaaaatatgtcaacatatctcgatgcaatacttggcatcatagatttggcagagtaaagggaccaaaatctagactttgagagacaagttaggatgagttcatagaaatccatcgatcccttctatcaccatacttctttcttacccttgcataccattcttttaccccacaacacagttttattctttccctggtgggctataaaaaaaaaagccataggaatatacttcttaagataaaatattctgccacaaattacttttcctagctaagaaaatgacagatttcacatcacttctgcatacacacgtattgagataaaaaccaaaaattttccatgtcagaagagcaatggtctattgttcacaagtgaatcttaattatctctagtccaattaaaactcggaatccttgtgactatctggatagcattgactgccatgattaggcagcaattctaatgtttttccaaataaatataaaggcatcatttctataagttaatcaagccattcaaacaaagacagaatcagggagaagaggctattcatcctgcctgattaagaatttttccacaataagaactgcaggaataggaaatgtgatgcaagcagaattataacaacattaattatgtttgctggttaaaagaatacatactcactgagaaaatttacaaagtacaaagaatattaaaaatcatctgtcgttgccctattcaaagtgaatgtgtgtctataagatacaaactaatcttcaaaaaccacaggatgtatctatgacttcccactgaccttctttttttcttttaagttccgggatacatgtgcagaatgctcaggtttgttacacaggtaaacatgtgccatggtgatttgctgcacctattaatccatctcctaggtattaagcccagcatgcattagctatttttcctgatgctctccttctccccaacccacagtaggccccagtgtgtgttgttcccttccctgtgtctatgtgttcacattgttcagctcccacttataagtgagaatgtgtggcgtttggttttctgttcctgtgttagtttgctgaggataatggcttccagctccatccatgcagctgcaaaggacatgatcagattcctttttacggctgcatagcattccatggtgtatatgtaccacatttttttttatcccactgaccttctattatgaaaaatgcctccacttttgcacagccaagaacactgcatgcctggcaggtgtagaggccttcgtcctccttcctcactctgcggatagtgaggttccggttcccatccttcaatacaatgcctaacagaggaagaaaacgatcattctcatttatgatgatgtagtctgtgaagtttttcagggaaatttagaaaatataaatgctgcccttcatcttgttctattatctaactctgtagagtcacatgggatctactgctgactaatctcctatatggctttcatgaaaattcaacagggccccatactccaattctaagtctgtgaaatgagccaggtcatggacaccaatactgctttttttctacattacatcaagaaataatatggctttttagataacatccctgggaaagttctgcaacccaagagtgatagccaaattctatttacctgagtcttctacaagggtctcattatctttaaaccacatgatctgtggagggggattcccagatgccgtgcatgagacttcgatgctttccccaatacttgtcgtctgattctccaggtttcctgtgatcgtgggtgccacacgctctagacacacaaaaagaaaatcacagaacatggaattataacttttgaaatggttctggtatcagcaaacttttaaacagtttaaatttagtaaaaaggaacttgttgatatattaacttctgggaaaatacactggtcactgggtaaagttaaatgaaacaagtcagtcaggacactgcaaacagattaatggcttttaacattcatattagtgatactagctggtaatcccatcacaaaagaaaggttcagggtcacctttatggatttttcctctaattagacacagcctccccaggtgaaaacttccctcccatgaagattctagtcaataataccctagaatcccttcaaatttctcttggaagtgccaaattttagtatcattcaaccaataatgccttacatttatttggcaattcttataaaacttgtttacacaatttgtgttcctcactagtgatcttatgtaatgagcagaataggactgttagcgttatctcacagatgaaataaatgatgttcagcgacattaaaccacttgtccatgtccctgcaactaagtaaacagttgaactgtttacagaatctggtgaggctaaaagaccagttcagtgctatttccactaaaacacaaacaaaacaacaataccctaagggaagtcttggatttaaagaaaatgaagcccatgagtatttgtttaagtgtacaagaacactttagatttattctttcttcagatcatcaaagtgctgtggaaatatcttgtcccaaccaactgaacatcaaaaggaatcatgctgaaaaaatccacgtcaacacttagcaaaatgagattacctcaacagcgtactacattgaagtctaagcaaatgtactggattctagcctatttctaagaataggttttaggaaaacaagttaggagtccttagggaagcaaagcagctaactgcgagcacatattttctgggcacagctaggccaggagcctacttcacatctctttctcaattctgccataaccttgaagccagacaagccaacagaaaatccatgtgatctatgtggtgtgacttgaaggatgctggggatgacttgaccccaaagtatctcttattatgacacctgagtcttaaaactagcgaactttatgctagtgtctgtcagaaggtgcctcttcaaatacgccaaggcctctgatgaagacgttaccctctaaaactgtggtatagatgaatttacttgggcaatttccttcctaacagtaaaaaaaaaacagagggcacatatatcctaggaattggaaagggacaccacaagaggagaaaatggagagaagtggcacaaagagacgctccccaaatttgcctgattttcccacagacaaagccatggctgcccagcttttgcacaaggcatgaggttagacaaggggtagacagtgcctctatggaggaatttacagagctatctgctcactgaagtgatcgtcccattgaccttgggctacgctggatcatgtgggatgacccagaggtacagacagtgaatgtagcttccttcccatggagtcttctaggtcttaaacgcagcccatcatcccactcttcatgcagcaggtgccttattgagcagttagtatatgctgctatgctctatgactagagctatagcagggagcaaaacagagaacaattcctgttctcatggacacagagacctcactgtgctgtgacttcccagtggttgcctatgttctcctcctttccttcatgtttaccactgtgaatttctgacactctcctagctcatagcaggcattccacaaatatttgtctatttaaataaatggatgcccaagataaggcagaagtttccctggttcaagctaatatcccttgcatatactagtgaattactccatcatcaggttttgttattttctcctttcgatatatcatttcattattattagcttctttcttcctcaaggactttcggtgaagaagtgtgcaccagtttacaacataatctcctagaggacagtaatctttgcatagcacctgaattgcactacatttaaggcattccaactgcctctgcacaatgatccagaattgtctccctacctaggactgtgagctgcctgaccacgcaatgtcttttcttggtcttcctgtcttgagcaaggcagacatagtctccttggtcctgcaaggatgcattcttaagctccatgatcaaaatgtcatttgtgctattagagaacatggtggcattcaatttccaaagagtatccaagttcttgcaaacaggtgtgggcaactctcccacatggattggcagaggctgtgggccaagcttgtaccatgtgaggttctcaaacgtagatctgtctgcagtgcaccacaaagacacgctctcctgctcagtgggctgcatgtcaggttgcaaagtaatttcaggaccccctaaaatgaagaggccatagttattgaatggtgatttaacttggtacagctcactatcatcttgctgctttcagactactacaaagtaccaaaagaaatgaagctctatccgttccaggtgatgtactacaacttgacaaacaaactagacaattcaggtcccaaaatatcttatttggccaaacacattacttgaaaatgtaaacgaattcctcagatatttaccacatctccactatgagctctacgcaatgtttaatatattaaaaatccaaagcaaaatctctaattctaacagaattttaaaattaggtcttcattaacactaacactcaatgatatgaaagctacatttatgccaatgaattagccctggctataatattccattcagcacaatcagctaaagcttatccataaaactaagatgcacaggcaaaatcggcagcattgggagggcactgctcctatgtccttctgattgcctccataaagcccaccctcatcaactgttccacagcaagcccaccaatatgtactgaagctcaataagccaggcactgtgccagactctgaagactgagatgtaaataccacacagagcttgtggtttaaagcatctgtgaaaccattctctctccagtgtagttagacgcactgacttcacataagcccaggagatacctgagaagttgtaatttatgaatgaaagcatcaatgatcaatccaagtcctctttcctaaatgccatgccactcacatgaatggcaaaaacaacagggaattacatagcttagtacccactgtgtgagtgatccaacccaaacctccagagaagagtacttactggtcacgtggaaggagatcaccctctctcctctcccgactttgttgaccgcttcacatttgtacaaagctgacacatttgccgcttggataacaagggtacttacagtctgtgcggggaaaaaacaaatcccaggccataaacaacgcggctgtttgtgcacaagcactcagtccagcagtctccacaatcactccaacctgcctatgccattcccacttctgcagcggttggacacgctcaaatttatgcaattgcaggttgagtatcccttactcaaaacgcttgggaccaaaagtggtttggattttggatttttttttttggattttggaatatttgcattgtatacttaccagttgagcatccctaatctgaaaatccaaaatgctccaacgagcgtttcctttgagcaccatgtcggcactcaaaaaggttcagaatctggagcattttggatttggggtttttaggtttgggatatttactcaatttgtataattatgctgctgtggagctcacacattatataaaaagggctttggaagccatgaaactaatgatgtgttttaatatgatatgatacacattttttcattctcatgtttataaaatcagaatcaccctacacagatgcatagatttaatgtcatagatgtttttatttttctctgataagctattaataagttaatggtactgctaaaagtcaatggtattttcaaagtgacttaatacgctctatttaatcatccagactatttgattattaatctccaatatgcctcacatattattgtaccatccttccattaaagagagagagattttcaaattttaaaacttcaaactcactttgttttttccttcaattagagcaaattgatttttattaacttcaattttatttcctccctggaagtcctccacacttctccattcttcacaagggtatgggtttgtcactgagacagcttggctataagaaagagataacagcgcatattatgatttaatttttctttaattagagtcaagagtaaggaaaagattcagactttggttattctgttcttagaaataacttccaacgcagcctaccatggtacaagacttggcgccaattaaaaataggcattgacaatgaaggaaaaggttctaggtagattcattcaggatacaggagggaagcagctattctgggaataaaccttcattcataaattggatcgacaagacaattcaagttaatttagttcaaaggaaggcaaggaaacttagaagccactgggctccttaaagtaatttctctgggaccatggtctctgtgaaggaaatgatcagcagctgaggaagaagctcatagtggccatttcaaaaacaacaacaggaagtggactgcttagggtggtggtgggttggctgctgttgttgtgtttttccctaaggatgtctggacttgtgtcagagcatgataagctgggcctgagaccctgaggactggggctgggtctatcactgcctctcatctatcagcatttcctctgagagatggatcttcacacacacaagaaggagggatgtggtattcaccagccgattggtatcgggagaaaaaccaaagactggcaattagcaaactgagcaaatagcctgtgtttggagaagtgtacctcacggctaacctaacaaggctgagcttagctaaccccaaaggaggatactccaagcaaagacatcccctaaaatgtaagacacagagaaagatggatggagattcaggctacctcttgagagaaaactttttttggtttaggcttctccatttaggatggagtcatatcatagctcagctgtaagaaatgcaagatggcaggaaagcaaagagcatgtggccttactcacctgggctcgttggcgcactcttcctccaactgccaataccagtggatgtgatgcgggggaggaatggcatagaccgtacatgtcagcgtttgagtggtgccgtactggtaggaatccacaggagagattagagatttctcaccaatctggggtgggactgaagatgggaaaaacaacttttgaattgtcagtcagctttgaagaatgggaaatagaggattttagcaactaaagctgactttctttaagcatatgattttgcttccactttctttttcgaagaacacctagatgtggaaacaagagacctgagttctagtgatactcataaaaataacaactagccaggcatgggggcttatgcctgtaatctcagtattttgggacgccaaggtaggtggatcgcttaagcccaggagatcaagaccagcctgggccacatggtgagaccccatctctaccaaaaaaaaaaaaaaggaataaagtaacgaaataaaataaaaatgacaataagctaataataataataaactaacaagctgaatgactttatggaagtgttgaaatcctgtgcctctcatctgtattacagagatagttctctctgtcctctcaagtttaggagatcagggaaaggctacagaaaacagctgaaatagcacagtaaatacatttattatgtgccaagcattgtttgaagtgctttgcatgaattcattcacttaatcctcacaaccactattactgtccacagctttatacgtgagaaaaaaatgaaacagaaaaaaatgactcgcccaaggtcactcagttaacgaacggcaaaacctggaacaaacctagacactctgacttctgaacccaaacacgtaaaccacctcatgttaaaggaaggtgtaaatctttagagaatgcattcctgccaccatcatctgagtttttcattctctctccctcttcctccctccctccctctccactccctttccctcttcccctttcttccttctcccttctctcacttccttctttcttctctccctttttcctttctttcttttttgactccaaagtcaaaactatttccttattactgtcaacctaaagcctcagattatgctttgaagacttgacttcttttttatgtttatttcatatagcagagaatttgctaaagtgaataaaatatttagtggcttcatgaactgatgaaatgggctatttgctgtccgtgttttgtttttatttcctgttcatttcctcctcccatcctacttatacactttccagtttctcctctccccagtcccctacacctatgctgcttctaaacaacctttttggaacctgttaactttttttttgagacggagttttgctcttgtcaccaggctggagtacaatggtgcgatctcggctatctgcaacctccacctcctgggttcaagtgattctcctgcctcagcctcccaagtagctgggattacaggtgcccaccaccatgcctggctaatttttatatttttagtagagacgggttttcatcatgttggccaggctggtctcgaactcctgacctcaggtgatccatccgcctcggcctcccaaagtgctgggattacagatgcaaaccacggcacccagcctatctttaaaatattccctgaaaaaaaataataaagccaagttcagcggcctacagaagagtatcaggacacgtagggaagcaccttaatgtcatgggaaaatatcctgaagttttaatatgccgtaccagaagggggaacaaagaattacaacagagaagcatttctcaaactgtttggagtgagagattaatgaatttgctcaggggaaaaaaggtgctctggtcaaataggtttgttaaaccttgaatactctatgtctctcctcctggagaataccaatatacattagcatataaaaggttctgcgaagtcctgcaataaagaaacctgttacacatctacacatcaccttagcacctctcacactcacttgaccatggcacccttctccccactccattccaaacacttatttgtacctttcagtttcagaaaacaaagttcaaattatctttacatcaaaaacttactatctttcctttacagactcaaaatcagatcctgaactcctgtcaaaaaggaaaaaagaaaagctcccaaccaagccaacagtgtcaacttcaaaagccttcagagttggaacgtgcctgcacatctctgatacatcaactacaacatcaaactagaagctttgcacaaaatctaaggagaagggtcttacacatctgtgtaccaggtgggcaattccatgagaggggaacatggtagtataacttagcttgacaactgtccctgtgggcattcttatttcacaacatttagctatcgagggtatcactactttaatcttgcatttgtccaccacaaagctcatttacacggcctcttaaacaaacatggccagagcacatggtcctacgtttcacttcagcttcaccacgccagatgacttttgtacgcaggcccagccatgatatgagtgaagcagcaggaggcagaggaacggtggtttggctgatttggaagacaatgtatcataataaatcttgggcagagaggaaaattgaatggactcaccatacacaaccagagagaccacatggctctgcttctcctttgaaatgggattggtaaggatgacagtgtaatttcctgtgtctctttcactcacttccataatcgtcagtacatgccccgctttaattgtgtgattggactcaaggggtattccatttttatacctatgaaaaaaaattctcaggaattagtatagtcaaaggatttgctctcacacgaaatgatgctttgcatttatttccagtagttaccattttatttctgggggtgggtaaccaaggtacttcgcagggattctgacacgctcccccaccgtggcttccaccagagattccatgccacttccaaaagcaacaaaaggtttttctggaagaaaataaaaaaaaaaaaaggtcaacttactgtaaatggtcatttgatttagtttttcatttcaagtgaaacgtcaaagaccttgagggtctgagtagctgcagttccaagatttcctgtactatctttcagtgggtcacttttcagcttctcccacacctcccgtgtttctcccacacctcctgtgtttgcatttgcttttctctccccgctagtgcactcccacaagcctagtgattgctcaagtctcaactcaaacacttgctcctctgtgcagctttctctaagtcccccagggatgcttgggtgctccttctcctctgctcccatgacagcctccacacacctcttccaccatgaggccccaggactcagtcctcagacctcctctttatttacaccttcctctagcctcaggtttaaagtatcattcacgtacctcctaaatgtgttatcttctgccctgactcctctgggttccgggttgatatgttaaatatctccacttggatgtttaacaggcatctccagataaacatatctaacactgtttccctaaatctcactgccttctcgatctttgccatctcagtaaataacaccatcatttactcagttgctcatgctaacgctcgagtcatcttccactctttttctcttatactccacaaccaatgaattgatcagcggaccctgttgactctaccttcaaaatatatccagaagcagatcacctctcactacctccacctcaactacccttgtctaagccacccctcaactctcacttggataactgcaattagcctcccaactgacctccttatttctgcccctatttccctgaagtattctggaaaacaaaagtaattctataaaaacataagccagagcacatctctctctgtgtattttgacaagtgcatcttggcaagtgaaataatttaaataaatttaggacacttagtgatttctattttgttcattcagaagaaattttcaagttcttgctagggatgccacgtgacctagaggtcaagagcatagctttgtagtcaggaacttgagttccaatctcagcttcaaagatgagatgagctaataaagtaagtgctcactaaatcatacttgttatagttgttgccacttttatgattacaactctaataaatagcattatctaaggtatttttaaaatttcactgtattgatgcattctcataatataaactccaaaatcctttccaaggcttataagtaggatgccacacaaattaccatgtaaactcagacatttatgtaaatgaaagagaataaacaaaaaattaaggtgattttctcaaggccagttcaatttaattccagttcaattacagttgacccttaaataacacaaacttgaactacatgagtccacttataagcagattttcttccacctctgccacccctgagacagcaaaaccaccccctcctcttcccccttttcctcagcctactcaacgtgaagacaaggatgaagacctttatgatgatccacttacacttaatgaatagtaaatatattttctcttccttacaattttcttaataacattttcttttctctagctttattggaagaatacagtatataatacatataacatataaaatatgtgttaattgactgtttatgttatcagtagggcttccagtcaacagtaggccattagttatgttttgtggaagtcaaaagttataccttgattttttttttttttttttttttgagaaggagtttcactcttgttgcccaggctggggtacaatggcacgatcttggctcactgcaacctccacctcctgggttcaagcaattctcctgcctcagcctcctgagtagctgggattacaagctcccaccaccacaccaggctaattttttggatttttagtagagatggggttccaccatgttgaccaggctggtttcgaactcctgatctcaggtgatccacccacctcagactcccaaagtgttgggattacaggcgtgagccaccgcgcccggcctatacatggatttttgactgcagaggagggaaagttaggggaactcccctgagttcccccaatccctgagttgctcacaggtcaactgtatattgctaaatgtttccccagtttgcaaagctcatgcttattcaagtaggcctctcagccttgcaataaaatgaaaatttaaaaactaccttagctaatactatttatcatagtaacaatcctaatagcagcaataactataataagtaatactaaatgaactcttactgtatatcagcacatctcatctttaaagttgaggtttgaacccaagttcctgactacaaagctatgctcttgacctctaggtcatgtggcctccctaacaagaaaaactagaaactatcttctgaatgaacaaaataggaatcactaagtgacctaaatttatttaaattatctcacttgtcaaggcacagaataatttccaagaccatagcttaccatggaccctgacaaatgtgctgttcttcttggtcatcagcccactggatgctgcacaggtgtacaatccttggtcactccgggttacaccatctatagttaaggtgctcaaaaatttcttcatctcactcccagactgggtttttaggtctcggtttacaagtttcttatgctgatgctgaaaaaaagagttgactgaacttccaaagcacagcatataacattacccaataacttctagtaacacacagaattaaatctgggctttggtaaacattatttaatgctaaaaacagggacaccagaacttttaacctcatgcagacaacaaatatattttgtttcaggagaaataaatggaaccaactgaattaggatttttaaaacctcacgtggtgaaagtgagatggatataaactgcagaaacacaagtaaatgtgaccactgtttaaggagcagtgtatctcatgccacctcttaaagagaaattcccttaaaaggaatgtagatcaaaaactttggagaacagagaaatgacataatgtggaaagatgtaatcacctagagaaaactaatattcatagcctggctattgcagaataggacaaaattcctggtatttcaccttttggtgggtgctatctgttctgcaattcccttaaattgtgtgtgtgtgtatgtgtgtgtgagtgggtgtgtatgtgtgtgtgtttaaggctcttacattttatctggccaaagaggcccctatctctcaagcaaacttcactggggcttattatctaagtatttggaggtctggctttgaatcattagcgttaccttcgaagaagggtattcccagttgaagtcaatccccacatttagttcagttcttgctgtacaatttaagacaagcttttctccaacagatagttcaattccatgagacggactcagaaccacatcataaatcctataccctagagcaagtaaattgaaaaaacagaacatgagagagcaaataagcctataactttgcacagatttattttttaaagtaatgcaactttaaaacatgccacattgtttttccctgcaggcctcaccaatacttggtagctcccaggaaaatggccaacagaggtttacaaagcactaccttcacagatctcaaagatgttgtaacccagtggacagaaaagtagtaaactttcagtggtcagtagccctaggccagtagggccagctttagcaaattgctgaagtttccataaaatagtcataattgaaataattgatagcaagcaatgctctgaacattgaattcttcataaaatgtgctcgagtaataccattcgctttcatcctttttttaaaaagttttctttttcttccttaatcttggcaagaaaagagacaacctcaattgcacatgggtttatttggtagagaagagcagatgaattgcccaacaccatatcctgagttcctatacttttcaatatccttcttcactctatgttgttatctccaagatcttaatacaaggatatgttattaatgatatggaaaggaaatgtcctcttacctacaacgacaactatgtacataatagactggtaactttcatcattaatttttgcttcacagaagaccatgccagcatagctgatcatgtagctgggaatagtaaagcccttcttgctgtcccaggaaattctgttaccatcaggaacaaatctcttttctgggtatctctgggtaataaaaagacatatcaaatatttaatccagtaccaaaaatgagagccatgtacaatgatcactgaagaattcatcttatttttaagaatactaattagttttattcattgcatttgacccttcctaaaggatccttaaaactcattgtgaatattataaacaggttacccatcttaatattagcttaaaattataaaaacttaagagacgattggaggagatgcaacttactgcacaaagtgacacgttgagatttgaaatggacccgagacatggaatcaccacagttttgtttttgttctcagtaatgtacacgactccatgttggtcactaacagaagcaataaatggagatctgtaatctagaagaaaatttagttttattaatgagttaatagtatttactagaaaagttggtcatttttcaggttcctaaactctaaccagacaagtgaatgactggaagggacacctcacacaaccaaaggcatccacagattattctgctgatagatatctgtgctacatgagggtgtgtgtgtatgtgtgtgtgtgtgtttgtgcatgcacatgcatgtgtatatatctgtgtgtataaaaattttgaaaaaaaactcccaattgagattgactcctttcacaaggtttattgacaagcagaatatatttttatagatttcacattttaaaagattaatcattataattttttcaaaatgaaggataatatttactttaaaatttaaagttaaatctatacactttaccgacaagttttactaatatttaaaatactcatgtgctctctctttaggtaaataatgtaaattccatgaaaataaatgaatggatcccaaaggatctttagattaacaggaaacagctaacacttttgaatttggttattcaagaggaccattcatgtgagcattttaagattctgaagactagggatatgattctttctaaaaccatgtttaattgtttttgcatttagtttaacatttagcagtcattgatatcttcaatgacaaacatttgaaaagtcaccactccaaagactgagaagaaaactgaagagattctgactgggttcttggctcacgcctgtaatcccagcactttgggaggctgaggcaggtggatcacttgaggtcaggagtttgagaccagcctgaccaacgtggcaaaaccccatctctacgaaaaatacaaaaaattagccaggcatgatggcacgcacctgtagtcccagctatttcagaggctgaggcaggagaatcatttgaaccggggggcagaagttgcagtgagctgagatagcaccactgcactttagcctgggcaacaagagcaaaactccgtctcaaaaaaaaaaaaaaaaaaagatttcaaggccaatcaaacattactcatacaatgttaacatgctgctggaaacctagtccattcctcagagatagagatgatgtggtgtggagtcatgcttgaaatctcagagagataacatttcacattgctatgcccaacacatcccatcaagcattctcagagtgcttcataatagtcagtcaaagtgaagaaagagttaattaaaccacaggggacaaaggcagctaattccctgcaacagcagaagtttgatttccttcccagctggaaagcacagaaaagcagccaatctagcccaccacatgccatagccattatcttatgaggccagggctcacttcctggctccatccattgctgaagagaatggggtcagaagactagggaagtaaggtggcgaccagaggggacattaaacacctatccatagagaatacttcagtgtttcctttcccattgtttaacttcatggccaaaatcttggacagcccaactcctagaactttaagcttagacaggaagcagaatttaatggtatacccaaagacaggcagtgtaccaataaacagtgctagggattgccacttcttaatattgcctacctttcatccacatgttatgaaatattacataacttgcttacagagcaagcctttggaagctaaattaaccctttgacgtaagactaaacctatttagtaaatcaattctatttcggtatctcaaaaaaaggaaataaacaaaagaaacccaaaccaccacccagcctctcaaaataaaatatttactgaaactcatgaaatgaattttcacatgtctccaagtttcctgacttaggaagaagtaaataatgagatatgggggatgttcatcttgtagtatttctagacaggctgaaagcaggaaatccttgcaatcttctgaccgagctgcatctctcaagactgccaggtcaaaaggagccagaaattctccaagatgtgagccttgtctctttcaaatcttgtggagggaaggaggagggcacagaattctatctttgacagtgcttactctgggcaaagatatttctcaaacattgtgaatccagtggcataggttattttgatgtggtctccactttttcattgcactgaccatattacactactgaaatgtaagcagagatatgcaagtgtgtttcccaaagctgatgaaattcttgccctgtaaaagctgcttctgggaaaaaagtctaagtcatcttcacctgtctcaaatactctgggatgtaaaaaggcatatacgtaaatacataaaatgtctgtttatcttcactgaaaagaaaaatatttggtacatccaaccaaactatgatgcagcccttacattccttaaatttatatcatagggatctcattagttaagttaggttttcacagaaaagataagatagtgtaagatttttgaaacacaaaagaatgcataactcattataaatgcagaatatgtgtgacatttattttatactatatggatgttaagtcagccttcataatatcaatcccaaactgcacatcctagaaagatacagcatatcatccaagatctcagaccaaacaagcaaaggaaagaaacattgtcctgaaaagagtctgaagcaatgtctttatttgcacatgagtatgggaattgttttttatgaaatactagtaagaaaaaaaggttcctatgtgcaaaaaactccagagcccttggcaaaaaatgctttcctatgcattcttgggaaaatctcctactctgctgtagataacttatctctccacagaaatttctccataattcacccccaaatcttcctcgatttcaagaattttaggttttcttctcaaacataggaagactttttataagtctcaatggccaacagtgaacacagatttaccttggaaacaaagatcagacccaaactaactgggcaaaaaagaggtaacacggcccaagctccagaatcaatgagtcttatttctcagagaaagcctcaggagagaagaattgtgtgtattcctcttggcaaacagcctttagagcaagccctttgttgtactcaattcttctttgagcctattgtcttttataactggtaaagagacgtgggaaatgaattttatttcaccacttaccttgaacatagacataaatgaccgaggccaagtcagtttcccggtagaagcacttgtaggctccagtgtcatttccgatcacttttggaattgtgagtgtcttacagaagaggccatcgctgcactcagtcacctccaccctttgctcactgccactctgattattgggccaaagccagtccaagtccctctgtcccctgaaaaattaatttcagggaggtattaatatgaagtgccagactgtgaggctatttctaagaaaagagaaaatttggttttgaaacttaaataaactcttcaacagacacagtcagtcttctaccggccaggcatggtggctcatgcctataatcccagcactttgggaggccaaggcggatggatcacctgaggccaggagttcgagaccaggctgggcaacatggtaaaaccctgtctctactaaaaatacaaaaatgagccaggtgtggtggcgcatgcctgtaatcccagctactcaggaggctgaggcatgagaattgcttgaacccgggaggtggaggttgcagtgagccaaaatcacaccactgcacttcagcctgggcaagagggcaaccctgcctcaaaaaaaaaaaaacaaagtcttctaccaacaagtcagattgacatatgatgaaaagttataaactcagcttcagaagtcacttataaagattcctgagttttccattaattaatgcattctttctttcaacaaatatctattaagcatctactatgtgccaaacttgttaaggactagagaaagagcagtgaacaaatcagacaaaaatcaatgcctttatggaacctcagtctaactggagaaaacaggcaattaaaaagtaaggaaagtttattgtataaaagatagtgtttagtactatggagaaaaatatagaagatacaaagaaaagagtaaagaattttgcaggaggtggtcttgataaagctagccataggaacatcatgaagagcagtattacaggagcaaaaacagcacatggaaaggccctggagcaggtgcatatctggagtattaagggaacagccaggaaaccagagcagccaggtaagagtgagcaaaggggagtaagaagtgaggttaggaaggaaggaggtgcaagtaagagtccctcaggaccttgtaaggacctcgcattaaaacatagatggcttgtactgcagcatttctctacaaggccccaaggaagataagaagatagtcaacatcaagaagaatgtaacattattggcccttcattcaaagaacttaaaatttccaggaagttgcagctaaatcaatgaagttacttttaacacactccatggtttttttcagaacataagaaatgtttatgcagagttttaaaaagggagcatgggatccttggggatttcaaataaccttgttatcgagggtcggtaaaaggaaaatctaatgggaaatgtgtcttaaacaagtaaagctagagaaacagcacctgctactgtgttttttcccaagggctgggtattggtaaggggctagggtattctttatactgcagtctaaaatagatgtatgtcattcggtttaatgcttagtattcaacaagtatgaagcaatggcaataacctacccaaggtcctttgtggacccccagcactcttccaggagggtaacatcacctccacttgtcacagtctctaccaaaaacacacaggtcctaagaaggctccatgcctttcgtgtgtgatcactatgttaaacccaagggtcttctatctttcgtcctggggtaagggttgaaaggcaaaatttaaaggcctcttcttcttgacaaagaagtctacttctccagttatcaaaaatcaatagcatgacttcttgctagcaagtggggaaagatgcattccagaatatcaaggcagggcccgaagtccattatttatgtagatcatgcgctcagtaatattacccactaaatattaaattgctattaaatattactgcctaagtaattatagtaataaatttcttataaagcaaagtttttggaaagggataataagtgttcaagaatcataccaagcataataaatatagtcccaaattttttcaactctattccttaaatgtatgccctcaacttcatttattcattcatatttattgagcgtatgtctactatacgccaggtggctgtactggttattggaatgtgggtgtgggtgtgtatttgtgtgcgtgtgtgtgtgtgtgtgtgtatgcatgttggcagagaatagtataaaaacaccagcaaaattgtacagaatttttgagagaaaattcttctcattttccattattacatcagttcttagaaacctcaccacttatgaacaattactacaagctctattataattctgctctactggaaattatttccactcaataaacaatcagttacttaacacaagaaatctagatctagaatgaatccttacctgcaagtaatttgaagagttgtattagccttaattgtaagtatgtctttttgtatgctgagcctgggcagatcaagagaaacactaggcaaacctagaaacaaattaaataaatgaatgtagttgccactgagttagacctaataggaaacaccttccataaacaatgcatactctatactttaaaaggcctcttcagcaattcattgtataaaactgggaatttacttttcaccattctcagtaaaagttcacaagctgtgtcataacaggaagaatgggcagatggtcataaaccaacacaacagttctgcaattcatggagctagggtggagttcctgttttcctgcattgccaacttcaaggtcttacaaaaggatacgggacattgaaaccaaatgaaccttcatctgatgatctcactcccttgggaaaggacccactgacatttcttatagaacataggatgtacacatttgactaaattgctgattaacgaatcccacttagacggatttttatatagttcatctacgtaccctgaagggagtgagagaatctatgaccttgtctcattttcctttatcaattttctagtgcgcttcccctggtaaccaaactgccacagctgaaataatggctcataaagactgtacattaaaagcaagggagagaaactgaggaagagaaaacattccccaattccacacatacatgcatattaatatacttttatgtatgtgtggaattttcccaattttacacatatgtgcaaattaatatacttttctgtctactgtaattcattagcattaccctttttttaaaaagtatatgaatattttcgtgaaaaattttcccagtttcacacatacatgcaaactaatgtacttttctctctattgtaattcattagcattacccttttttaaaaacgtatataaatttttttaagtgcaatgctaatgaattacaattgggagatctgaacttattcatcaaagccctgaactcatcctgacatcaagcttcagacataagaaacttgtctttacctataagggataagaaccagaaaagtaccatggcatagattcctcaccatgggtcactctacagcaagataactgaattctctgtcaactaaatgtgaagagctatgaggtgttgaaaaagcatgagagaaagaaaaattgtccactatgctagggtcttaataaatatcaagacctagaaaataccagctttaaaaaagtaattgatgttgggcaggctcccaagctttctaagtcatatcaactaagaaaaaatgactccctaggcctaaactggcattgaccttgctgggcaaataagagagtatgaacaaataggacgaagtatgagacggaataaatagagagagtataagtaaatacccagtgcaaacatccagtgcattgaatctgaggatcccaatatgaacaaatgcaggcaaaatgaataagtgactgcacatgttctcacacaccacacagatgtgcaaaataagttactgacataactggtcaatatcatggtttttaagtcaataatatggtttttaaaaaactggaaactaagttatatcaatatatctcagaaattaactggcattggtactgacttatgtttagaacagttttgttcttaagactttagactctgtcagaatatccctgggtctacaaatctgcattttaacaagcatttcaaattatcctaccacagatggtctatgggccactcttggacagttgctggtctgggtggtcatgtttaattaatttgcacagtactttgtgcgtggaacgggggttacatttatgttttaaatagagaatggggtctcgctatgttgcccaggcacttcttgaactcctggactcaagcgatcctcctgcctctgcttccctaagtgctgggattacaggaatgagccactgcacccagcctgcacagtactttttaatatgaaagaaataactgcccccaaaacaggcaaacaaaaaaccaaaatgtttaaaagcaaaatgaaacctggagtcccactttgtctaagaaaaggaaaatgaaaacaattcatttggataacacagatttcaaacttgactggggaacactaggttgagaaagatgctgaaaacatgatgtacaattcacactgccatccaaatgagaaaaaaaccattatttgggcacattcttgtgagaaaacaaatggcagtaaaaatgattctcaataaactgtgcccactcggctaccaaaatcagaaactcttgaaggtctctcataatttattgccacagatcacattctagacacactttcctgtgtaacaaatattttaaaaaagaaaaggtatgtccttcattcataggaagctgagactatgccatactattctagagacacgtttacaacaaaaatctattcaacaaggctctcaataacttcaaattcatatttgtagaccaacatagttttttgttttttgtttttgctccattaaatgtcattcgttttcattggcaagcttgagctggactcttcagaaagttctaaagaaataactgtaagaggtacacatgctactactcaataaaaagcccttctatgttcaaatcccataaccaatattaattaatttgtgcactgttacccttccagctcaaagacgggaaggaaaaacaacagtgcctctgtctctagaatttgatggcaccaattacagcccaatccaattaagcaagtaatgcactccaaaagggcaagttcaccattatattcagggcgaccggcctgccgttactactacgctaggaaacaccccaggcttaaaagcaactcacttctttgtggaatacagagcaaccacatgttccagaccttcattctctgcccagaaagggggagagagagggcttgtctgggacaaatgagtgtccatggtggactggacccgttgaaccaagtcattataaagaaaattcagtaaccatggacagatgatcctggtactgtatgtgggtgtgagtgtcttctaagacatgtgattcttgtcttagggagtaagaaatttttttccctgaattattcgactttttttttttctttctctgaccctttcccctttctcaccctgcaaagggtggaaatctggatatcagcaaactggctgcaggaaagaaatattatctaaggggttgagagagaaaggaaagtgaggaagaaaagacagacagctattgcatgaagaacgtgtgtgttcctaattgaaggagacggaaattttaggcggcagggagaggaaggaatggcactaaagctaggtaccaaggcccacaggaaaggttttcggagcttgaacttctgactatgcgcttacaccaaggaccacagcgctttgaaagatgtgcaatgctttacgcaggacagttggctgttacttggagacccttggggaagctgtcaaagcccccaggacaagtccctattcccccccttcttcgctctgcaaggagagcggcgtcctgcaccaaggaaggaaaaaaagtttctctccgctccagaccccacttcacacagtggtgtgcaagtgtgttcgagcatgaagacaacaacgggccgggtcccgcaaagaggcagaaccgagtgtaccgtccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaagagcctgagggtgtgtcggcatctcaggacatgctccagccgaggtccctgtcgcaaaccagagtcctagaaaaggaactgggctagagcacaggcgaccacagactcgctgggtaatcttgggccagtctctgagcctcagtttccccactggtaaatgaaagatcgcaaaatgtcaagtcctgtccaactctccagctctacgattccgagttagatctggctttcaggtcctctccgccctcacccgacctgtctgccttcctcctccagagtgggctccttacccacagaggcggcccgggtctccacgcagagccacagggcgacggccagcagcaccttgctctgcatcctgcacctcgagccgggcgaaatgcccagaactcgggagccggttctttctcccagcgcctgtctagagaaggaggcgcggaggtggaactcgcggcaccccgcagcgcaggacagttgagcgcacagggctagggagcccgggcgccgaccgcggctgcaggggcgtctgcgggtgccggtaggagaggatatccaggctgccagacggactttctgcggcgcgcaagtgatgcccggcgcaggcagaggaaacgcagcgaccacacattgaccgctctcccggggtcccgggactcagtgcagggtgggagctggtgccgaaactctagagcgcggaggcggggccatgcggggcggggccggagcggaggaggggctctcccgtgcggccagccccgcccctcacccgggtacccggcggcgatctccagctccccaagcccatttacatctccccatttccccacacaactggactgcgctgggccccaagtcgcccaggagagaacatcccagagcaacaactttgtttctggtgtaaataaaaagtactcggtaacgggcgctgagcaactccaagatttaatcgcttgccggtccccgaaatttggggagcatcaccaggagcgctgcgaagagcagcgctccctcaccaggcgcgtcaaagtgcaggaccctcttcgccatcgcgcgcgtctgaagtggccgagaatctgcagcagtttggagccacaagggagaagcggatactcagccaagtatgccgggtcgcaagctggcagcgactcctgccagtagttttggtttttgtataagggtattttgtttggccagtataattgtagtttaaaaagctgaatctggttgctcttaatcagaaaacgcacttgcccagttcgccaacattcccgctatttcccaaaatatttggcggctccaagtttgaagtgacctgcctagccccaagaaggcttttgtccatcgtgctccccaacgaagagccctagtgaaagtttggccatgccccttttcagagcagagcttccagccaagatatccttagtcccaggggaaggaggccagctgccagcgtgcttcagtggaggagcaatgaagcaaaagcacctaggacactctgtgaccaaattgcacaactgtctccacgtgtgtggacttcttgtggcagctgtttggaggggaactccaattccttcctgaccacattcgttccttctggttttctgtccatatctccccacacctggggagtgacatcaaatgtcccctaacttcattaaatatgaatcttccagatgcctatgtcttttacctcccagaggtgctttttaatgacaacctaaaggaccattcttcaccaagataaacacacagaattattatatctacacctaattcaaactagattgattgtatacaattaatgtaacctgttacttatcttcatctgtttttaaatatttactgtattcacgcttttacttttccaagttgacaggtgaaatattttaatgctgaaatataatgaatgtatatggcaaaaaaaaattttggaaaaacacaaaaaggcttagagtgaaaagacttttcttttggcagaggcatttttatgtttccttttttttccaagcagattcttaaacacaagtatgtagacatgtcacccttctcttcccacaattgcttggtataaatgctatttgagccttggcttttttccctttaaatttgatttatttatttgagacaaggtctcactatgttgcccaggctggtctccaatgcctggactcagtccatcctcctgcctcagtctcccaaagtgctgggattacaagcacgagccaccctgcccagccttcactttataatatacactggagattcgttctacatcaacctttaaagctccatcttttatttatttatttatttatttatttatttatttatttttatatagaggcagggtctcactatgttgcctaagctggctgcgaacaaagctccatccttccatcttttcaatgttggcatagtgctctactatatagatgtactcatatttatctgggaggtatttatttggggaggggagagaatctttaaagaaactcctctcttcctgctagtaaactcagcaaataaaataggatggactctggcaaagttggataaaggggtgggagatggaacctggtttggagagggcagtttttctccatccccatcaccaaacaattccctatcagccttatttacagttcatgacacttcctcttccatgtctcatttaagaagatagtgtctcctctgaatgcaaaccagaacctgcaggcccgtggtaatagccccctttagaagtcttggaggaaatgatgcgtctttgatggccgcaagaccagaatttggcagagtctcaatgaaatcagtctaccacattccctcccacacagcacttagaagtgccttaggttcacaaaaaaaatggcaaagtctgttaaaaaaaaaaaagatagaaaagaaagaaagaaaggctgttccatgtgcagcaccctctcgttatctggcattgcaaaggagtgacttttgtgagttaacccaacagtaaggcacctagcaaagtgccccaaatgtgttgagtgttccatagatgctattcagatgccacagcagagtagtagctaagtgcacagactctggattttattcccagatctaccgcttatgatctgtgtgatctttaccaacttacaagtaacttatctatgaaacacaaaaaaaattataatagtaccttcttcatagggttcttacaagaattaaaggagttactgcatgtaaggcacttggagtaggccccaacacagctagtaaagatcttggacatagaaagcaccagatacacattaagaaacattctgcaaaggttgcttatactacaatgcatgggcttcttcatgctgctgagatctaaactgctaagcaggctcattcattcaacagtttttgagcacctactatatgctaggcattgaaccaggaactggggttacgatggtgaaaataatgtcaagatgagcttaaatgaggaatcattgtaatagcctcacccaagacaaatttaatttaatctttaagcacttcttgtctccagctacttttctgggcttgtacatacagaatatacattgttcatactcaaagcacactgcataaattactctccatgatctccaaatttggttacattaccaacagtattttggactccatgtcttaacaagttatatgaagatttgtcaaaggttaataactgtggaagttcaattgcttcaaagagaataaaatacccaggaatccaacttacaggggatgtgaaggacctcttcaagaagaactacaaaccattgctcaatgaaataaaagaggacacaaacaaatggaagaacattccatgttcatggataggaagaatcaatatcgtgaaaatggccatactgcccaaggtaatttgtagattcaataccatccccatcaagctaccaatgactttcttcacagaattggaaaaaactactttaaagttcatatggaaccaaaaaagagcctgaattgccaagacaaatctaagccaaaagaacaaagctggaggcatcatgctacctgacttcaaactatactacaaggctacagtaaccaaaacagcatggtactggtaccaaaacagagatatagaccaatggaacagaacagaaccctcagaaataataccacacatctacaaccatctgatcttcaacaaacctgacagaaacaagcaatggggaaaggattccctatttaataaatggtgctgggaaaactggctagccatatgtagaaagctgaaactggatcccttccttacaccttatacaaaaattaattcaagatggattaaagacttaaatgtcagacctaaaaccataaaaaccctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaagaaactaccatcagagtgaacagacaacctacagaatgggagaaaatttttgcaatctactcatctgacaaagggctaatatccagaatctgcaaagaactcaaacaaatttacaagaaaaaaacaaacaatcgcatcaaaaagtgggcaaaggacatgaacagacacttctcaaaagaagacatttatgcagccaacagacacatgagaaaatgctcatcatcactggtcatcagagaaatgcaaatcaaaaccacaatgagatagcatctcacaccagttagaatggcaatcattaaaaagtcaggaaacaacaggtgctagagagcatgtggagaaataggaacactttcacactgttggtgggactgtaaactagttcaaccattgtggaagacagtgtggcaattcctcagggatctaaactagaaataccatttgacccagccatcccattactgggtatatacccaaaggattataaatcatgctgctataaagacacatgcacatgtatgtttattgcggcactattcacaatagcaaagacttggaaccaacccaaatatccatcaatgatagactggattaagaaaatgtggcacatatacaccatggaatactatgcagccataaaaaaggatgagttcatgtcttttgtagggacatggatgaagctggaaaccatcattctcagcaaactatcgcaaggacaaaaaaccaaacaccacatgttctcactcataggtgggaactgaacaatgagaacacatggacacaggaaggggaacatcacactcctgggcctgttgtggggtggggggaggggggagggatagcagtaggggatatacctaatgtaaatgacgagttaatgggtacagcacaccaacatggcacatatatacatatgtaacaaacctgcacattaaacctagaacttaaagtataattttaaaaaaattaaaaaaaataactgtggaagttgaacagtggtacttaaagattcatttgactattctctctacttttacgtgtttgaaagtttccatgattaaaaaaaaaaaaatctgttttaaatgactgtaatcaaagggatgcccaggccaatacaacactaacttttccattgtcttttccttgatttggtgaaaataaggatttggaatgtccttgagcattatcttttaatcatttcaggcagcagcttcatcatttgtcaatgaaaataataattcttacctaccttaaggactgttacgagactcagatgagatcatctcatggaagtgctctataaagtgtaaaatggtgatggtggtaataaggattcaatagatgtttaattttcttccttaaagtacttgttaccaaggcctttcatcaggtgtcttccacacataccttcatcgcctaagaacatcagctgttcaaaaatatttcctggccaggtatggtggctcatgcctgtaatcccagcagtttaggaggctgaggcaggaggattgcttgatgccaggaggctgaggctgcagtgagctatgattgcaccacagcattccaccctgggtgacagagtgacacactgactaaaaaaaaagatagtattttctatatttctttgagatatagatatagatatagagaagagatacatggagacatacatgcataatagaaaattttgcagaaaatatctagaagggtacacaccaaaaaaatacctaccttggggaaatgattgaggcacagaggcagagggatgagaacatgtactttttgcttcatatatttctataatttttttcaaaccaagaaagtattacttttacaaataaaaaatattataaaagacatcaactctcttttctaggggctgttatatttttaaatatgaccatttattgattacatgtttgcattgacaactttgtcatgtttactgtatttttctttccatgttcatttattttcaacttaccagagcctatgactacctcaccagatgttggctcagtttcacagcccatccatacttacaactattgcgacttgggagatcatgagcataccctttgtttctcattatctaccttctttaaacatctaagtttattttactccttgtgagatttattcatttaacttaagctatatttgtatgttcaagaaaaagaaggctatgtcaccacaaagccaggcctgccttgaatgtgtccaacagtgttcaattttattcacaaagccttatattctagtaaatataaagcaaactctccatccttttagtgaaagagattaaagagaacttgattacttgctccctgcaaaggaaaaaaatctcagttactataaacacgtataactatgttccagtcccaaactctcccgtataatttcttggaatatctcacatgagaatagatacaataatttttaaatgtgtaaaatatgcaaagaatttaaataaccaactgaaagtccacacagcaccagagaagggtgctaaaaaatattaagagctaacactttttgagcacatcatttgagcaggctctgttctgagtactttatttctcatttcatcctcataacatcccatgaggtggcaagcactattagtattccttagaaagaaaagaagtaaagagaaaaaatatttattcttaatttaagtaaatgtccctttgccttcctaaaagtcttgcccaaaaaaaaagttgttatatctctttgtaaataatcaatgaagttttttcatcaataattaggaatatggtaaaaaaaaaaaacagggcattctttgcttttttcaataacaataaaaagaaggggtagatttttggagcagttactatgtgtcaggtattttccttggattatcttatttaatgcacataataactcaatagaaaagatactataattattcccatttaagggagatgggaaaatgaggtttagaaagtttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaggtttagaaagtttaagtaacttttccaatgtcccataactgtaagtggtggaatcaggacttaaaagcagagcagtattaagcacccaaaacagacccctcctagcacatacaaatagctttttgtttttggttttttgtttttttgaggactaatctcattcaaggcatgaggctaagtgaattgatgccactgacttcctctgcctctccataacaatagcttccattttcctagatgcatgaaaagctaagtgacttagaagaggcactctgagatggctgaccaaggaagaatgcaaagcaggtaattagatcttgccctccccacctgcagaatcccagccgcattgaatatttaccttccacccaacccccaaaccacagatcttctcttcaaaaaaaaaaacaacaaaaaaaaaaacaaaaaaaaggagcagttgcttctatacaaataatcacttgcgcatttggggcatttcttttctaccatgaatttttgtcatttgtcctcctggacataccttccatacccagtgcaaatatctgtcccaagtgatatgttttgtttttttattcagctgtctgcttcaattcagactcttctaggagaaataggcaaaggtaaatcttacctgagcaagtagttaagtttggaaggatagttggtaaggtctaataaaaacggttaaggacatgatgatggtgcctattaataaaatctattttgtatactatagacttattgtgttatgtctaattaaataaagctattgtaaagatacttgggttaatgttatatgtgctagctatataaaatgtactttatatgattattcttaaattcaaatttagataatagtcatccatttaataaatatatccagttatgctgaatttatacttgatcattgacaaattaatgtggactattttgttattcacagaactaggaaattattttccttttcctgtacgcacatagcacttatgcaacatctgatagcataatcacatatttattcaaatatttctccctcaaatcagggattaggtcacattgattttgtattctccgtgcctaacacagtccctgtgcatattcacctctaaacacaataatgatgtccaagttatttttgttatttccatttctgctgctatttgttcctcctttgctttttatttttccagaatcacatgcctcttgactattcattgcaaatgtctttacagagagcaacttgtgggaataaatggaaccatacaatgtcaacatagacacaacggagtgaaagagttagttcttaatttattaagcagtggggattgaagatttttgtttttgattttgagtacaatgaagaaaaagaaataaagcatttacaagatttgcatgtactatacaagaaacgtgtgattgaaatgttgcatctgtgtcatttgcagactcgtaaccattttccagtgaattaataccatcctccccctttaagcctatcaagttttcaaagaactgaatagtgcaaaaatatacttttggttcccagagaagtgctacagattaccattcccatataagaagaatgtatacacttccaggttagttgaattagtttgcaatactgttcacatttttagagactaaaaataatgtttcctggtaatgccacttcaccagtgttgagagcaagtcaatgacagcagaaaagttttatgttctttgtatataaatttagtctccagagtttccaaaacattggtgaatagtccctggaggcataaataaaatttttttctttgagcagtgtttctgaacgttcatttctaatatatcactgccttgcttcacttaattaaaaaaaaatctccgcaaggaatgcctcacaaagagagaaatttcaaaataaaatgaaaaatacaactttagatctaattgataatcatccaataattggtcaggctggtcataggcagatgaaaggctgtaagggagtcatttcatgcatctgatcacataatataaataaaagatccagctgtggagaaaatgattctagtaacaaagcaccacatcaaaaatattccacattaaaatggtctttggatatatagaaaaatgcttctatttccttatcctaagaaaacttgaccttgctgctccctgaagctacttagtagtctagtactttgacctttccttcaaacgagttcttgaaagataaaaggacatccctcaccttctctcctcatgtacaataacttcttactcttgactctgcccagcatctccacaacagacatcccattgtccaccctcttcttgaacttccgtctttgttgaagcttgaaacattcatgggtacactcctacctaccagccaatgcccttcactggctgacattcctttgctcaaccctaaacatagggatcgccaaatccattcttggtcaccatcccttgtactcttccatgactttctcaggaattgtatttcctcttttgcctttgactatcttccttatggagaaaacttgaaaaattgtgctctccaactctgattttctaccctagctccagcctctaatctctaattcttcctggacatctctgtgtatgttccaccaatttcttaaattcaaagtgccaaaaactgaattctttgtctgtttatacccaccctgcctccttcagccttcttaagctcgaagtccctctagatgcttatactacattccatgatatccccctgccttttcttttcctctcaaatccaattttgtctacattctttacttccctcatatccatctcctattttcattcatcagactgccctgactcgtgaccagtttgcctttttcctggaat

SEQ ID NO: 1119 - DNA, 122694 bp, Homo sapiens
ttttgtgctgcctgggtcagccggccactttcagcaggcttcactctacaaggagctttttcctctgaaagtgacttctgtacaccaattattatgatctgtcacctctgaagccatttatttcaatggctagtgataagtattgatacttgacaggattttcaacttggatttcacaaacctcaagtatattttctgttctctcccatgtcactattcctttagaaaccaaaattacatcaaaagtgattcacctgattgcagagctcagtctgtgaagtgggtgcctccctgccaccccgagattcctagatcggccatgagcgaggcatatcaaagagacctgccctttgataaccacgttttattttcaccagaaggcatcttctctctattgtataatatatgattccagggtctatgcaatggttctgtaacttcaaacttctcgagatgaagagaaaaatgaaaccctttgtaggcatcattcactggaagcactcaaacttaataaagatgatctattgtaaatgcaatacattttctgctgggtttagcttatttatcttcatggtacagccttatatatgtgggatggatttgaaccagatataatatgggtacagttataactctgcaggaaatctcctaaaagtaacagatcttacctttgtaataaagatagccatataaaatttttggtataaatcgtgcagcacaagattggcataattcaagcatagtgcgccgtctaagttcatgcatgtggcgtttcccacaggcagaaataactcttccaatggcttctatttgtccttccatagttgaagacaaagaagacaggctctatggcaaaattatgaggccaccaaaatcaatgctccaagccccattcttcatatttcttcttttctctgtagcaattacaagtttttcttttgttttctaaccttctcaggttcaaagtcaaacctcctaataagttttctatttctgcaaaacaaattgcttctacactcagcaggttttcttttaggtttttctttctctcttttttttttttttttttttttgagacagagcctggctctgtcacctaggctggagtgcagtgcagtggcaccatctcagctcactgcaacctctgcctcctgggctcaaaccatcctcccacctcagcttcccaagtagctgggattacaggtgcatactaccatacctggctaatttttatgtttttagtagacacagggttttgcagtgttgcccaggctggtcttgaagtcctgagctcaagtgattgcccccctcagcctcccaaaatgccgcattacaggcgtgagccacagtgcccggcccacactcagcagtttaaaagaataataaacaattactgtttcatgttgtttccatgggccagcacagaggagtagctgaacttgagggtttggaggtctctcaggaggttgcattcaaaatgtcagtggctgtggaggctccacttgggcttgaagatccatgtccatgggggatcattcacagggctggcaaactggtgttggctgttggctgttggctggaggccttaattcctcacgatgtgggtctccccacgggagtgctggagcgcctttacaacatggcagttggcttccctaagagcacaggttggaagccatagtgtattttatgatctagattcagaattggcacaccataatttttgcaatatgctaggtgattataaagttcaaccttatttatttatttttttactgtaaaaattttttaactttttaattttttgagtacatagtagttatatatacttatggagtatatgagacattttgatacaggcatataatgtgtaataatcacatcaggataaaggaagtatccatcacctcagcatttatcttttttttttttttttttttgaggtggaatcttgctctgttgcccaggctggaatgcagtggtgtgatctcactgcaatctccacctcccaggttcaagagattctcgtgcatcagcctcccaagtagctgggactacaggcatgagccaccatgcctggctattttgttgttgttgtatttttagtagagaggggattcacggtgttggccaggctggtctcgaactcctgacctcaagtgaaccacccactgtggcctcccaaagtgcttagattacagatatgagccacctcgcctggcccacatttatcctttgtgttataaacaatccaattatacttttttagttatttttaattgcacaattaaattattgttgactatagtcacctggttgtgccatcaaatactagctcttattcatgctgcctattttttgtacccattaaccatcctcactccccccctcccttctatcctccccagcctgttaaccatccttctactctctgtctccatgagttcaatttttatttttagctcccagaaatacgtgaaaacatgccaagtttctctttctgtgcctggcttatttcacttaacataatgacctccagttccatccatgttattgcaaatgaaaagatctctttattttttatggctgaatagtattccattgtgtatatgtaccatgttttctttatccatttgtctgctgatgaatacttagattgtttccaaatcttggctagtgtgaatagtgctgcaataaacatgggaatgcagatatctctttgatacactgatttcctttcttttgggtatatatccagcagtgggattgctggatcaaatggtagctctatttttagttttttgagaaaccccgtaactgttctctataatggttgtactaatttacattcccaccaacagtgtatgaggattctctttctccacatccttgccagcatttgttactgcctgtcttttggataaaagctattttaactgagatgagatgatatctcactgtagttttgatttgcatttctctaatggtcagtgacattgagcaccttttcatatacttgtttgacatttgtatgccttcttttgagaaatgtctgatcagatcttttgcccattttgaaatcagcttattagattctttcctatagagttgtttgagctccttatataatctggttattaatcccttgtcagatggttagtttgcaaatattttctcccattctgtgggttgcctccactttgttgatggtttcctttgttgtgcagaggctttttaacttgctgtgatcccacgtgtccaatttttttcatgcaatacttgtttttttatagtaaatacagataagcaatccattcatacctacatacccataaccccaattccagaagtcattattgttaacattttggtgaaaacatatccaggtttgtttgttctaaacttttgttgtactatggtgtggacctcctgctctaccaaaataaaatagcggacctggtgtaccctgcctccctgttttgtctaatacctagacacaaatttgcttcaaaacaaatatttattgataagtcatgttattgatatgtgccaggaattttgttagcccctgtggatttgcgagacagacacagtccaaaccctccagacactgttgcctaggaggaggggacagtgacatttgatactttcagcactctccattacagtctttacagtggtatgaaggggaagcctaaaccagaaccgcctaacctcacctggccaggtcaggggagctgctgcggaacgtgaggctcaaacagacatggcagatgaatggaaattgacagaagagaaggcgaaggccaaccagcacaaatgactggcacacacaccggcgccaagataaaggacccagaggagagctggtggatggtccattgtactgtgtctgaagacacctcaagtggctatgggaccactagcattaaaatcacgtatgtactagttaaaaatgaagtgttctggcccccatgccggatgcactaaatcagcatctttttctcttttaacgcgttccaggcactgggatacaagttgaagtttgatagccaaagccctagagtctccattgcttgtgtgtaatggccggggagctcttgcagtgcaagtcttacagggtcttccagaaccagctcagcaagggactccacgggaggcatgggggacaggcatatttgccgaaccacaaaaagcaaatgaatgaaggttagttaccatatttcatcaactgcacgggcactttttttttctctcacattttaacttctctgaaattggaatgcacttataatcaatggcaagtagtaatttcatcaatagccttgtcttccttttttggaatgaagcaaataaaatggcgtgccttctgcgtgatgaaatacagcagttgtcttcccccacagtcccccaggctctccttcctcatcgagaagacccaccgaggggatagtctacatccttcagaatatttgctgccatgttaatttgtactgcatgaactttctccttggacacaattttgcccctgatatctttcatcactttcttctggcacctgtttcatttttgcctttagtcacagagtctcgtttaaaaaaaaaaaattgaaatctgttcctggggtgcgtcttctggatttatagaggtatctctataaataaaaatctcaataaccaggaaactgagttcagaatgcttcctctgcaactgagaccaactgaaagaatgaaacagaaaggcagagcattcaggagtgaaacttgatatctgaacagagaggcctgttctggaatttccaaggctgtgggctccatctcgggcaggaaggcagtgacaaaggcccttcctggggacttcctagtaggatgcaggggtctgtgtggttccatccctctctgtgtcatctagtcctaacccttcctcttccccgaccccagtctcacccaccagctgcccctgccccagctgccctgatggttttcttctaaagatgttaggaccctcatgtacagcctctgcctctgcagaaaatgggaagagcctcctctgcagagcacacaatgatggatgaggtctgctgttcctagaacccagaaacttggcatctagacccctgtgtttgccattcacctcttctcatgtatccctattatgaacagcaagggccactgtccaggcaaagtcatttcctctatggaaggggcatctcccaggaatgtgagagtttgcacttgacagaccctggaactaaattacacagacaactgcttacagataaccctcttggccttgtggctgctcccttgttaaactgaaggcactactaacccgcccccaaccttttttttttttttgagacaaagtctccccgttgcccaggctggagtgcagtggcacgatattggctcactgcagcctcaaactcttggcctcaagtgatcctccttcctgagtctcccaaagtggggggattaaagatgtgaaccccccttttctttggggcagcatgtttcattttttggtgagacaaaatcatccgtgctgcctttgaggttctggtcacatcagttagtcacagagacacgggacacacacaagctgcttggtattgccgtctagtgagcttccatctgccctggggctaatgctcagctcattggtgggttaattgtgtcagggcttgccagttgccaatcaataactactgtaactcttttttagcaacagaactttgatcttatttagaaccacagcggcgcccagttaagtggactacatttccaagactcccttgcagcttgactatgtgactgaattcttgcagatggaatacagtcctcctggggtatgcaggcaattggtatcaggtccctgaaggacaccaaaatccatggatgcttaagtctcttgtataaaatgatgtagtatttgcatataatatttatatgtccttctgtaaactttaagtcatctctagattacttatgatagttaatacgatgtaaatactgtgtagttattatactgtgatagttgtattcttaagttgttgtattgttattttgtttctttttcttgatatttttgatctgcagttggttgaatttgtggatgcagaacctgtgaatgtagagggctgactgtatatgcagaagagtgtaggacttcctggaagtctctttaaaggaagctaactcatctgggaggataattcttcctcttgtcagctgcctagaaagtgtccaagatagccagtactatagcagccatcttggaccatgaggttacttgccttcaggatggaagccattgcaaggatgctggaaaagaaagatacaaggaatccagatccctgattgccaaggagcttccgtgctagccctggactgcctgtctctgggctcctttgaagtgtgagagagataagtttccacttcacctaaaccactgctattttcaattttctggcataggcagcttaacccaatcctaacaaatgcatttagcattgtaagagtgttacctttgaatttcatgactaaatagaggatcattctgtcatcctcctaggatataacaagctaaaaggagcagcatggatgttggggttaacgtgaataggtctgaatccctgcttggctgctagctgtgtgctgcaggcaataattcagtctctctgtacctgttttgtctcccacaaaatggtgtgcattaaattaattaatgcatataatatgcgatgcccacagtaaggaaccaacaatgttagtttccttgtcttcccctcttcttcatgttgtgcattttattttaaatacttaaaaaattctaggtatacgttgagtatcccttatccaaaatgtttgggaccagaagagttttggattttggagttttttggactttgggatatctgcatacacataatgagatattttggaacacaagtctgaacaaaaaaaaattttttttttttttgagatggagtctcactccgtcatgcagactggagtgcagtggcctaatctcggctcactgcaacctccgcctcccatgttcaagcaattctcctgcctcaggctcctgagtagctggaattacaggtgtgcaccaccacacccagctaattgttgtatttttagtagaggtgggggtttcaccatgtttgccaggctggtcttgaactcctgatctcaagtgatccgcccaccttggcctcccaaagtgttgggattacaggcatgagccactgcgaccggccaaaacatgaaattcatctatgtttaatacacaccttaggtacgtagcctaaagggaattttatataacatcttaaataattttgtgcactcatcacatgtggtcaggtgtgaaattttccacttgtggcatcatggcattcaaaaagttttggattggccgggcaaggtggctcacgcctgcaatcccagcactttgggaggccgaggcaggcagatcatgaggtcaggagattgagaccatcctggctaacatgatgaaaccccatctctactaaatatacaaaaaattagccgggcgaggtggtgggcgcctgtagtcccagatacttgggaggctgaggcaggagaatggtgtgaacccaggagggggagcttgcagtgagccaagatcacgcccctgcactccagcctgggtgacagagttagactctgtcccccccaccaaaaaaaaaaaaaaaagttttggactctggagcatattggtttggggtgctcaacccgtaaatgcagatttgggtttatttccacacaagctgagcctgctatcataaactcagaaatatgccggtggggctgggcgcggtggtcatgcctctaatcccagcactttgggaggtcaaggcagatggatcacttgagatcaggagttcgagaccaacctgaccaacatggagaaaccctgtttctactaaaactacaaaattagctgggtgtggtggcgcatgcctgtaatcccagctacttgggagactgaggcaggagaatcgcttaaacctgggaggtggaggttgcagtgagctgagattgtgccatggcactccagcctgggcaacaaagtgaaggttcatctcaaaatatatatatatataccagtggagttagattaggtagaaaaacccatggttggccggtgcggtggctcatatctgtaatttcggcactttgggaggctgaggcaggcagatcccctgagcccaggagtttgagaccagcctgggaaacatggcgaaaccccatctctaaaattaaaaaaaattacaacaaacaatcacggttaatgtacaggacagagtggggaagtcaagggaagaaacattgaccagggtctccagaataaatctcatctaactccaagaaaagctgggctttccagcagaaaccaaaccagaggcatatgggctagcactcagtttcccatggagttttggtccccaaaaccctgagcaacgtaggactgtaggactggcagcttttccagccagtcaattgcaagctgaccacttggggaaacactgctgtgtggggtagaagcagaaaggcgatttagctggtgagacacaaatatctccaaaactaagtgtatttaaaaggaccccagcagccaaatagtgagaaaagcagtctatgtgggtgactgcagattaatgccttgggctgactgcccagtttataaacatcctagtgccctgccctaacgtaagaaaaatatgtcaggagaattcaatattgtcagtcccttggctgggccatagcgacggtgatggggagatgcacgataagttactggaatgggggaagtggaccaccctggtgagagaaataatggcaggactcccaccctggccatgacccagtccgcagtcacgtacagacgtagttttccaattgttttactcttgaacccttctggcaggacaaaagaccctatggacgttcaggtttgccagaaaatagttatataagcttagagttggaagaaaccagctaactgagctcaatctccctctccacttacaggatgaagtgttccagggaaagggggtcaatgtcacagctagttaatggcagagccaggcccaggatgagtcccccaattcctgggttgtgtgtttcatcttctagcattaatgtggtcaagggatttttttcagttatattttaatatgtggattaacttatcaaccaactaggggatagtccttactttaaaacacacatcttagtgtgatctgaaatttcatactacttagagggccccgggatactcaagctttggggctctgcacatgtggagccaaggaagaaatgaggaaaacagcttacaaaagcttacaggagagagaggaagcctacactggaaagaaggaccgtgtttttaaaaactcagaaacaacagcttagaggtttattggtctgacaatagaaacgattggagagtatgatgttgcactgagtctccctctgcttccagaatagccctacaagacagaggcctggatggtaaaacctacaacacttccaggcaagtattttccccagaaggcactgctctagcttcattctccatgcagtcaacacccacaatgtgctggaggttctctatatattggattcttatgttcctttggtaggagaggctggggaggacacagaagccagggatgtgatgtgtacaaagtcacatggttattgatagagtcaatattcacacccagttcccaaattaactctaggcctctttccacaatgtcagtaagccttgggggagatgtaaacaggagctttaactcccgggaaatcccagtggagaccaaaggtgctggaaccctgtgggctacctgtccctgcattacccacaccatctgagctgctccccgtgcagcctgctgcccgcccttcaggaaccagcctctagggcagctcttgcacccacagtaaaagacaacggacataggtactttcatgcaaaatctttatttggaacatgtatgttactgagcaggccagccgccatcctgaaatagcaaggatatttacactgtgcagagaaatacaagagcttcttgaagacattcatctgtgctttgccggcattttatctgctactttgtcctgcttctctcttccctgtgctcattattcttcatgcaccctcacctctcatcaccttaaggcatcctgtaccagcctgatctgggggcgatgactgcagccggcaatcggccattaccaatggtgtctttctgggaccctttctacctgtcttaggtattaatggtgcccaaagaaaaaatgaagagatgaaagtttctgtggttagctgggcatggtggtgtgcacctgtagtcccagctactaaggaggttgaggtggggatagtgcttgagcccaggagcttgaggctgcagtgagccgtgactgcaccactgcactccaggctgggcaacagagcaagaccctgtttcaagggggggaaaaaaagtttctttggagttgcaaggccttgtcttcactaaattttagaagtccccccgagatgtttctgcttaacttctctgacaggcctgactgtgagggctcgaatttcagctgacctaggtggagagtacttcattgatttttataatctggaaatgactgcttttccccttgctgggacatatggttttcatttctgtttgctgccatatgcttctcaacttgaacttgcctttgtctccttgctccgtgacaatgaatgtctcacatctcggctctgctgcggggcaggggtgaagggaggtggaagaaagaagagatggtcctttggcttggttgtaagccctagtagggcctgtctttcatacggaaagggttcctcctaacccctatcaaagcatggggatgaacggccagacaatctgggcttgcctttgggtttaagtttcagtcactaaacagagaccacagaacaaggacctccctgtcctctgctgtattcgtacacacaagtatcgcagaggctttccaaggtcgatgccaggaatctgcaggagccttggctgccttcccacactgctgatgaaccaaggactgtttcgacaggcaggttgctagcccacatcaaccttttcaagaggcctcaatctgaatttatggtcttaatgactccctttttatttctttccaacaaaacctgcaggctggaggccattcttcctttaatgttattttatcatctcccccttcttagtgtggtgggtcccagagtggaccaacccacactcctggagaaggacctcccgccatgcagattcttaaaggtcactggaatgtgtctcttaaatcctgtcctgagtagcaactctcctcccacagacagatgtacagaatctgcagtcaaaaacaaaacaaaaagaaaatgcaaaaatcccccagcctgcaacagcttcggcttaagaaacacactcccaccccacatcccgtcttttaagcttcatctcccctgcataaatgggtctggtagaacaatgctccccaacgctaaagtaattgcttctaagaacttaggacatgggaaatgtttctctaagctcaaatatggatagaaagacaattctgctgcactggtcactttgcaagagatgctatcctgacatttaattgtgtattatttaatcatttaaaacaaacaataataaaaaactcagccagaacacgcaaacgtgatctctgggggtcacaagatgaaatggtaggtgaatgttatcttctatcagccccttttgcctccgagttgggaaagtagttgtttcaacagatcagcttcatcctttttcttcagaagccccaaaccgagatgctgtcagaataagtcattttgctgctgcaaaaaatgatcacagtctggtttctgagtcatctgagttttaaaacgtaaacttccattaacaacggcccttcaccaacagtaaaatggggcagcaaaagttctacttagaatttccacgtgaatgaaacccgcaacctacaactctgctaaggaaaccaggatctcaaagaacagattcatgttttagggactttaaaagaagaaatccaagcagttatgcacatggacataatcctgaaaacccagtcaggggctgggtgcactgtcagtgaggagtttttctgtactttgcagaaacatgaggttgaaagtgataatatagatatttggttttcagtcattcagaaattttcttcaaagaaaggcaatttgagctaaattaccatcattttcccttcttttgcaaatcaagaaatactaatccattgcatatgtaatccctcatataatttttagcccaaatggtcaaaattacaacttttaattttatgagctccaaattattaaacaccaacagtaaattgtgtgcatgagaagaacaaagacaaatacaaaatatagaaactttttcttccagccacaaaaaacgaagttatgtatgtatgagaaatagaaacaataactaaacaattagtgttaaattcaagacctctgggaaagctgttgttggttataggctattatttaccttagaatatgaaagtttaaaggtcaaattttcaagttaaacttttcaagttaccttccccccaaaaaagatttacatgtaggcttaaatttagaacagttaaagtataaatgttgaaaatttcaacttaattcagaatggtttcagaaagatatgatacaacaatttaagataacaaaacagaagcgcatcacattttggtttgagaatcacagaaggtacaacagtttttcttccttggggatccttctctttctcttgaggaatgagctaaaattaagttattttgattcaaagaggtatttagatggtatcaacaaaatttcagaggaaatcagaacggagttcatatacatgtatgggtatgtgtgcatacatgtacgagtatacatgtgcacgtatataaatgtatatacacatataccttcttacgtttgcatttaaagagggaagaccccacaaagacctccaggcgcctcagcccttatttggtactaccaggtgacttcaatgattcaccagctacaacagtgtctgaactcttccccactcaacttttcctgggaagaggatctttttgtttcccgcacttattgctgctgtgaaaactggagtgcactctcacttttcataagagctgaattctggactgcagataagtgttttgaaaaggcttggaaagatttttcggggcgacttaggttctgttttgtttgttacagtccaaatacataaagttattatgaaataaaatcatacggtacagatgagaacaggccgggacagcccggccagccgttttagggccaaaggacagatcacccaacggttcacattttaggaattcgaaatgtctaaaaatagataaggtggtttctctaaaagaaaataaaatgaaagagaaggggaaaaaataaaagggaaaaggaggacagggtgaaggaaggagggcaagaggtagcaagggagggaggacagaaggaaggaagaaaggaagggagggagggagggagggaggggaaatgatttagggaatgttagttgtcaggaataccttacttagaaagaaggaaaaaaatgcatgaaaaaatgcataaactttgtgcaggttaatgcagtattaaacacagtagaatacataggcctcataatgcttttgtaatggcatatatataatgtccccaagcactttctaaaaatatgcagagactaattcaagatcattctagataaaaatacgtatttctttaaaggggtggggtggcagggtgggaagaaaagcatggtctcagggtagatccccacacacatacaaagataaaactatgttttttggtaattctagttgatacggcagcaaaaattgtcatgacaatgttggctggttttcagagggttattttcaaatataacctgatagctacacttgtacaaaaatctttgtgaaaagtttcttttattaaccctgtgatatgtctatattgacattttctaagataaaataaaagtagcagagttgtcagtgggtaagggacagagctttaaagcaaaagtgaaccctctttgggttcctctcacacaaagggatacagactcttaaataaaataatacttccttaaaaatctgccgcctaacaattgtttacatcatagaaaaatagcattttcgtaaaaagaaatatagtcactttgttaaaatggtctattttaaaccagcaattatttttcatataaagaatttctaaatacccatacagaaaataaaaatagataatactgagtgcaaagcagacaatggcgtgtttgcaaatgatcaaaatatttcactgccagataaataatactcttagtatattacagtacaagttttaatttttcaggaacttaaaagatattgcttttattctctgatggcaagttacttataagtaaagttacttccagcagcagaaggccaaattgattagaaatggatcatacctattgattcacatttcccctaaactgaaagtgctgaaacaccgggcaacagccagtgtcccaaactccttcacaagagcatggactgcaggccatggagacacagaggggagcacaccattcacaggcctttccaaagcatttgctagatcttccacattgaaatcttcacccagaatgagagcaacaccaaactatttaccagcttagtcaaatctgtcatgagggagggtttctgtgaaaactccttcctaattataggcattaaatcttcatgctataaaaacagatggtttcaacggacgattgctttatcgccacaaagcaattctgagaggatggcaagtttcctagtggcagtggtaaagaatgttatcaggatgctaaaaactcagcagcttccagcttctacatggggaagtggggctgatagactaaatctaccagctacttgagaatactcaattcgcaacggaatgcaagctccaccggcatttcatcacaccctctccactctgctagggtcataggaatctgtaaaataagaaaagaaaagaaaattagtgttatattcaactgctctattttctgtttaatccttagaccacgaatttgtctagggaacaaaatctacaagtgtataaaggttaatttttagacattttaacaatcatgttttcactaaggagtaaaaaactatttgtcaaaaaggctgttttcaaagaattgtgcatagtcattacccaaacacagatgggaaaatatgaactgctgaatacttcggcggctccttcctgttcaccgtggaatatacttcactttaaacgcaatgtttccaaactggcagtgatgtgtttggctgatattaaggtagatgtcttatctttctttcttcttcttcttcttcttcttctttttttttttttggtaaattacagctcaaaagaaagcttgctttagaatacgcatctttgtgatcaaacgctgtcccttgaaggcgtgaggatcctcaaatcctgactgcttggctggcagagagaggctttctgtctctcatcaccactgaccactaggcagccccagggctggatgctcacctgtcagcgcaaggcttctagagccttctaacacaggtatgtacgagtctggcccctcacgcactgatccattctactgccgtcaatggaaaaatcccaatctgtgcccagatgacctggatttctaaaacgggacaccatacaaaagagcaatcatcctaaactgccactactgctgctgctgggtgctgccaagtcccacaacctccaattcacagatgtctgtctggaatccagacaaacctaaggctcacacgtgcgcctcctgtggtaagattttcctgccatagcagctcaaaggcttcttattttttaaagagaaaatgtctaagcaatctggaaggagtacagccattatggaaacattatggaagttcctcaaaaaaattaaaaatagaactaccatatgatccagcaatcccatgactgggtatgtatccaaaggaaaggacatcagtatggaagagatatctgcactgcagcattatttacaatagccaagttcactgcagcattatttacaatggccaagataggaaactacctaatcatcaaggttttcatgactggatgtatggataaagaaattatatagccgggcacagtggctcacggctgtaatcccagcactttgggaggccgaggcaggtggatcacctgaggttgggagttcaagaccagcctgaccaacatgcaaaaaccccatctatactaaaaacacaaaaaattaaccaggcatggtggtacgtgcctgtaatcccagctactcgggaggctgaggcaagagaatcgcttgaatccaggaggcggaggttgctgtgagccgagatggcgccattgcactccagcctgggcaacaagagcgaaactctgtctcaaaaaaaaaaaaaaaaaaaagaaaaaaagaaattgtatatacacacacaatgggatattattcggccctaaaagataagcaaatcctgccattttacaacaacatggattaaacttcaggacattatggtagtcaaaaaagccagacacagaaacacaaatactgcatgatctcacctatatgtggaatcatttaaaaaaaaaaaaaaagttgaaatcacagtaacagagagtagaagggtggttgccaggggctggggtgaaggaaaaggggaaatactggccaaagggtacaaaccctaagctataagatgagtaagtactggagactgagtgcataggatggtgactttagttactaatgccatcatgtacacttggaatttgctgatagagtacatctcaaatgttctcagcacacactcaaaaaaactggtaactatgagagaagatgactatgttaactgccttgactggggtactcatttcacaatctatagatgaatcaaaacaccatgttctataccttaaatatatgcaatttttgtcaatcatgcttcaataaagctgggaaaaaaagaaaaaggaaaaaaaacagcaagtctcggcatggtcaaaaaaggtgattcacttaaaaaaaaaaaaaaaggaaatctggaagtatctgaaaagttagaaaaacaatcttttggccgggcgaggtggctcatgcctgtcatcccaacactttaggaggccgagacaggtgaataacctgaggtcgagttggagaccagcctggccgacatggcgaaaccccatctctactaaaaatacaaaaattagccaggtgtggtggtacatgcctgtagttctagctactcgggaggctgaggcacgagaatcatttgaacctggaaggtggaggtggcagtgagctgagatcgcaccactgcactccagcttgggcaacagagtgagactcggtctcaaaaaaaaaaaaaaaaaaaaagaaaaagaaaagtgaaaaacaatcttttctgaaatccatctggacaactgtgcattaaaaaggccatagacattccaatttttccagcagcaaaatgtcttacacatcctcctcactccttttcaacctggctgagacagatgtatgatacaacaggtatcacgactgtgatgactgagacagcattcagagtacttaaagccctacattactacccagatgggacagtctctgcatttaggaaaagaagtttgctcaaacgtcatcagctgcacgcaggaataatctggctaaaaggaaggggagttcacataaattctttctgactgttgatgcttaacaacatccatgaaacaatataagacattaatagctgggtgcttcatttctgtgctcaatcagcctcagagtgttcacattctgagagggtcctcctgtgagcaaaggtgtctttttctccattgagaataaggtgtgcggtcatgaaattatgagaacgtgtggaagtcacacttcggctagtgggagcacctgttattaagatgcttagtttcttccaggctaagcctcacattacataacactaggcatggaacaggccatgccatgtctgtctgtaccaccccacccaacacacacacccttcgagacccttactatctgtgctgtgttgtacctaccatcaagtgtctttagattacagatggtcatttcagctcacacctttttagtggtcttttgtgccaggcacactagagacacctccacaggacacacctgctgcccacagtcccctggctctttcttcagctcatggactatccaggtccagtaaaattataatgtgggccacaaaacattattttttagagacagggtctcactctgtcacccaagctagagtgcagtggcacaatcacagctcactgcagcctcaaactcctggactgaagtgatcctcctccctcagcctcccaagtagttgggactacagacatgcactaccaagcctaattttgtttttcagtttttgtagagatgggggtctcgctatgttgcccaggctggttttgggctcagatgatcctcccacctctgcctccgaaagtactgggattacaatcatgagccgccatgcccaaccatcattattttaaatgttctagtagctatgttgaaacacataaaaataaacaggtgaaattaattttaatactgtatttcaccaaatatattcaaaatatcatttcaatatgtaaccaatataaaaattattgagacattttagattctttttttgtactaagtctttggaatctggtgtgtatcttacacttacagcacatctcaatttgcatgagccatatttcaagtgcccagtagctgtatgtgatgagcggctacaatattggacagcacaggtctagagggtagggtggttacccggagaatttagaatcctgtttcctgtgggctccatttcagctgaggacaactcactgaggactgccctggtgggtatttcacacattaacgccctcagagatgtgctaacatctagccttctcatggcatgatctggtatcatgaagccttccccgatttccctcattttgggcctcacacagatatctcttctcattcttcccctggactcatattaacagagtttgcaacagaggatgatggaaccaggaggttctgtgtacgatcaatgcctgggatgacacttccgaattggagcatcagtcatccagcaaagatgggagtctgtgacccgaactcgttttgggctgttgatttcttaaccagaggcatgaaagaccactaaagacatgtgagctgaaacgaccaactttaatctcaagacacttgatgatatgacaggcacggcacaagggtgtgtgtgtagggtggggtggtgcggatagacatggcatggccttgtgttacagtgccagaacagatgcttgaatttaaatgggctacaaatttaggagcaatgaagcagttctagcatgctggggtcatgggggcagcagtgcagtggggaagagatgaggattcttatgtttaaaatgattaaatacatcaaaaggaaagcaaagtccaagcgcttctcagtgacttaacaacaaggctttactctaacttgtgaagcaacagtgagcggaaaagtggacatacgtcaaaagtattactacctccatcatatgacctcagttgctctcaagacgagtggttttgaatattgaggcctggtgaccatcacatgaaaggcccacagggggccacctgagcaaaacaaatgtaagatatcgtccctaatggtgctctcccctccgattatggtcatgcgccacagaacaacatcttggtcaatgacgggccacatagatgacagtggtcccataagataataatgaagctgaaacattactgtcatctagtgacgtcatgtcatagtgcaatcaatttttaaacaaatgtggtgtagcctaagtgtacagggtttataaagtctacagtagtgtagaggaattttctaggccttcacattcggtcaccactcactcactgacttgcccagagcaacttccagtcctgcaagctccattcatggtaagtgccctacaaaagtggtcctttctttttttttaatattttatgccatatttttactgtgccttttctttttgtttttttggagatggagtttcactcttgttgctgaggctggagtgcaatggcgcgatctcagctcactgtaacctctggctcccgggtttaagcaattctcctgcctcagcctcccaagtaattgggattacaggtgcctgccattacacccagctaatttttgtatttttagtagagacaggttttcaccacgttggccacaccagtcttgaactcctgacctcaagtgatccacccacctcagcctcccaaagtgctgggactacaggcatgagccaccacgcacggcctgtaccttttctttagatatgtttagatacacaaatgctttccattgcgttacaattgcctgcagtattccatacagtaacaggctgtacaggtttgcagcctgggaccaataggctctaccatgaagactaggtgtgtagtagattctaccatctaggtttgtagaagtgcactctctatggtgttcacacaatgacaaaactgctaatgatgcatttctcagagtgcagccccattaagcgacgcatgactgtacttgaaaatgcccgaggaagctgtcaacatgagtggctctctgcctgcagatttttggccattttattgtatattagcaaatgcatcagatggagaggagaaaaaaataattaaattttctgcttgttagtagcagtggttaaaaaaaaaacccaaaaacgtcatgagggaggtgttgttaataactggctaaaattaaaatttgcattacctgggtgtttttagatacctactggaccttctcacactaaatagtcaagttaaaaattgaaggagtgcttttctgaactggaaattttgtgttatcaaatactccctagactgggcaccataattgaggcaggaggattgcttgaggccaagaattcaagaccaacctgagcagtgtaggcaagacctcatctctacaaataactaaaaaaatagctgagtgtgatgatgcatgcctgtagtcccagctacttgggaggctgaggcaggacaatcgcttgagcctaggagttcaaggctacagggagctatgatcatgccactgcactccagcctgggccacagagtgagactctgtctcaaacaaaacaaaacaaaaaaccttcctgaaataggtttccatgaactgagacacagaaatatttaccaactggtactgtattataacaggatttatttgtcttattttaaactccttacaattttcaggaagatgtaggactgagaaaatcatcctgattttatagatgaagaaaacttgctttagaagtctatgacaagttttaactaaccttaaagtctagtgggcatattttttgaggaggaagggggactgcagaggaattatgctgaaggctacaataaatccagaaagctcaaaaaatgggcaggtaacccttttcctaccataatggcaaagccttcacattctcagtattctctaccactgcaaaggcccagcttgtccaactagaggatccaacggggccccgacgaaggattatttcaatcatgtgttttgcataaggagcagagaagcaacactggctaacacccctaagaatcccactgtatttgggggaaacttgagagtgcccatgtacatttttttttttttttttttttttttgagacggagtcttgctctgtcgcccaggctggagtgcagaggcacaatctcggctcaccacaagctccgcctcccaggttcacgccattctcctgcctcagcctcttgagtagctgagactacaggcgcccgccgccacgcccagctaattttttgtattttcagtagagacggagtttcaccgggttagccaggatggtctcgatctcctgacctcgtgatccacccgcctcggcctcccaaagtgttgggattacaggcttgagccacagcacccggccctacatttttttgttcaatagaaatctctgactacttccaactgaaacaacagctcttttctatctgcttcaaaattcttgggtttcaaaacagaaaatagaaaggggtgggaggagcagaaccacctgctggagactgggtaggaagagggaagggcccagctcaggagagggcattcctctaactcaactcgtaaggaccaagtttttcttttccccttactgtaaaaggcttggactgggccgggctcagtggttcacgcctgtaatcctggcactttgggaggccaaggtgggtggatcacctgaggtcaggagttcaagaccagcttggccaatatggcgaaaccccatctctactaaaaatacaaaaataaactgggcctggtgacacacgcctgtagtcccagctactcaggagtctgaggtaggagaatcgcttgcacccaggaggcggaggttgcagtgagccgagatcgtgccactgtactccagcctggggaacagagtgagactctgtctcaaaaagaaaaaaatgggaaggggaggggaggggaggggaggggaggggaggggagggagaaaaggcttagactaaatgacagaaggtcccttccagtccatggcttatgatgtggatcttttgacatttatctcaactcttctactgatcacctgagctcaggagttcgagaccagcctgagtaacatagtgggatctcgtctctataaaaaaattaaaaaattagctggaaatggtggtgcatgcctgtggccccagctactcgggaggctgaggtgggaggatcacttgagcccaggaagcagcggaggttgcagtgagcagagattgcacaactgcactccagccaggcgacagagtgagatactatctcaaaaaaataaaatatactgcaagatcttgaattttaaagatggcttctggataattcttcgaaaatgaggaatcttttgataaaacaattcccagggtcaacttgatcttttctgaatatgcagatttacattatccaccaacctggtattttgtactgactaaaaactccaaatgtatactgagcacctgcctgtctgcctgattcctcacctgggcaccagaagtcttgatccatgctcttctccttttgtgctgccggatgctccttctcttccctggagatgctgtccttggacacagagagtgagtggcccaatctctgggcacggtccccactgccaggagacacaaggcctcccgggagcccggcctggccccttgtggtggccttcaattcctcggcgtcctcctgggagtcggcattcctgaagctcaggactctcatccgtgacactgagctcacctctttcattctcatcaggcggtcagggtctgctctcctaggcggggaggccagtttctcttgtaaactttcaatcactttggaagggcttctaagtctcttttcagagcctgccacacttggggttctttctacaaaatggaataaagtggacctgaagggtggttttgtttccacatccttttgttcgaagaacttggactccaaggggctgggctcaggctcagggacagggtctgtgctggtgacaaccccgtccacatctgagtgctcaaaagcctgaggagcccgcctggcactgtccctgtcccctacaaagagagggctcttggtccagccgcacttcctcctgccataaaaggcatcagtggacaccctggggacatctgccggtgctgggcgagatagcaactcttcctggggggactctggggtgcaggcacttgcatcgggctcagcaggctggttctgtcccgctctccggatgcccggcaggagggactccaccgccacctcaatgcccaggatccttgcagccctggcttgcaaggactcacctggggggatttctattgtgcttgcttcacccaaagacccctctagctcactggcaccctgttcttgcccaggggtgagccccacagaccgtaagtctggagctgagagccctcggttcttgttagacagggacagtgggagccctgcccccctctctccaccactgtcaaacttccgagggaccgcttcacttggtttcacagagctgaaagcactggtgattttcggactttcctggggctccctaggttcagctggataggacgcgggcagtggttttgcgtcacttgatcttgaagacattctcgtcacaggaaatgggctacctgccagctcgtccattccgttgctaacctccaggtgtctcttctctgcactcgtgcttccatctgctgagcagaaaggtgcaccgccaccttcttccacgcgaaagcggcccggggatggaggccaggcacgtgggtggccaggctgcagctcctcactccagctctcagacttactctcacctcttcccgacctacacacagggctctccggcacccacatcctcggctgtggctcaaccctcatttccgggctgtttccgcggaagcccacatcctcctgtctgcagtgagcacggttctcctgctgcggctccgcctcactctcctcactgctgctgctgctgctgctgctgctactgctgctttcttcctcttcctggagctccttgttaaaactttctaactgactgatcaaatcccagggacgacggctgaccggtttcaggagaaactgcccaaagagttgtttactgttgcaagggcccgtgggctcccccttcaccacctcccgcttaggcccagggtgggctccaagcccgtggacatccacgcagggctgacttcggcctgcttttggcgtcggtgcctggtccacggacaaggaagtccttgagaacgcactgttgctggatgggctgagggacctgtgacctttcaggttacgggcacttggcctctgtttgtgatcaccggtagggaatgctgtgtgcgtctgagcttcggaggcagcagggtctgaacattttggactcaatgctgcacgactcggccctcccagctttgcaccagggagcagctgcgaactttggggctcctcggagaaactggtttgtgtttgctgatctctgtaccggtgccctggccaagagccagaatgcttgagttctctgtgctttgtaaggtggatgaaactgaggtcatttgtttgtctgtcttcttctggttcccctagatcttgtttttggaactccgttctcccacccatgcttcctgtgagggcctgcagctccaggtcggtggaagacatgctcagcagactctgttcttgcagagccgggctcttatcagacccattcttttgatcagcactgggctttaagtcattgttgtccatatctctatctggcagatgtgattctgatttcactgggatagaaaccaagcaaaatatagtctcgttcatttttttctttgaacttttcttggtccgagtcccagtttggaactttttgagcttggtttgagtttcgcaggtgctctcgccctgtgagtaaggggaggaaacttgtcttccagtgtgcccgtgctggctgcctctcacatcaggccactgtccccttgccacacagcggtctctctggttggggaggccactgttttccccatccccggggggctggccccacagccaccgggggctggaatcggccaagaccaggcctctctcatcccccgacgggggtattaagctctgtggattccaaatggcaccatcaggctgcattcctccatgagccggctcttgagcagtgacaggactggagttatatgatttatcgtcaagctttatgtcttcacagaaaccctggggctgagctagtttaaaatgtcgtaaccgtggatcatcaaagggaatgtactgaacgaagccgtcataggcagtgacaggtcggggatgtgcggggagcccctgaggcaagcgggggctcacaccatactcattcccagttccaggggggcctgaaggaggctgaccgctggccccagccttctcggtcggagactgctgttgactgtgaccgccacacacatttatgggcaccgtgtcttccaagtaggggtttgggatgttctgcgggggcgatctgtatgagggcggaggcacgtacactggaggttccaatccagggtctgacaggcagagctcatgcctggggacataggcgtccatctgctggctgtcctgagagtcactgctgtccgctcctcccctagactgctggtgcgagctgtaagatgggggcttgaggggcctcccaaacttaggccggggaaatggggctgagcagccactcttctcagaattcctcgtggagtccaaatttggtgcgcaagtgggaggatacggtggcattttaggtgaatgtctttcatttaatggaatgggaatttccgtgcaactcaggctctcgggggaaagaactctaggcagtgagcgagacttccctttgttttgagaattcaacacatgttctccttgaatgaatgggtacaggtcttgaaacagtctctccccatctccatcagacatctgcctccctaatttccttggctggttccagctttccaggctgacgttctgccacttggcaggacctgacattcgcaattcttcttcccaaactggcttcttcatcacatgctctgaccttcctccaacttcccatggaccctccctcacgtggacaggcaggctgtgggcttgggccattcctctggcctccaggttttcgtgctccctcggcttctggctcctggcttcttgccgtcctcttctccggtaggcttggtcgttaccagtcgggggatgagaggaccatgctgaggggggttgattacaaaacctacaaaacaaagagtcacagacgttaggcacagaagaaacatgtcttcatctgcttctgtgactggcattcgaagtcaaactcaggtcagcaactttgaaaacttggttcccagccacagtacttgccagcttgaaagaaaacatatcccattaattatggttggaagacagccacgtgttttggcatcaagggccaagaaggggcagcagtgggcagcccacaagaatacagggatgttgggtgtactccagcgatgtcaaggtccttataaacattaaaatgtctggtggaaggccgggcaccgtggctcatgcctgtaatcccaacacgttgggaggccaagctgggagaatctcttgaggccaggagtttgagaccagcctgtgcaacatagtaagactctgtctctacacaaaatttaaaaatcagccaggcatggtagtgcccacctgtctcagcaactccagaggatgaggtagaagaattgcttgagcccaggagttcgaggctgcagtgagctgtgattgcgccactgcactccggcccgggcagcggtgagaccctgcctcataaggaaaaaaaaatgcccaagggaacaagggttaactgttcagtagtatttctcaaggtgtggtcttggaccacttgcagcatattgccggctcagtccagacctcctgtgcaatctctgggagggaatctgggaacctgcttttaaaaacactgtttttaagcaagggttctgaaactttagtgagaatcagaatcactgagtcctggaattgctaagagagagattgctgggtcccatccccagcttctcatctggcgggtctggagaggggctctataatctgcaagttcccagatgatgctgatgctgctggtcccagggccttactttgagaatcatcattgctggtggttgttcaccctgactgcacattagaatccaggaagacttcaaaaatccagatgccaggcagtatcctagacacattacattacaatcttaagacgtgtgggtggtaaatggagggcgaggcaatcaggcatccgagactctccaagtgtccccggagattcccagtgtgcagccaagattgagaaagatgtctctagcagagtcccctcatctctctgatggtaagcatcacccagtgggcttgtaaaatatacacattaccaagtctctcccactgaaagttcagacttggtaggtctgggttagggcccaggcatttgtatttatatttttatttatatatttatttttgagacagggtctcactctatcacccaggctaggtgcagtggtgtaatcatggctcactgcagcctcaaactcctgggctcaagcaatccttccacttcagcctcccaagtagctgggactgactacaggcactccatcatgtcttgctaatttttaagatgtttttgtagagatggggttttgctgtgttgtccagtctggccttgatctcctggcctcaagaaatcctcccacctccgcctcctcatgtgttgggattacagacatgaagcaccatgcctggcccatctgtatttttttttttttttttttttttgagactgagtctcgctttcgcccaggctggagtgcagtggcacaatctcggctcattgccacctccgcctcctgggtgcaagcaattcttgtgcctcagcctcccgagtagctgggattacaggcacctgccaccacacccggctaatttttgtatttttagtagagacgaggtttcactatgctggccaggctggtctccaactcctgacctcaagtcttccgcccacctcggcctcccaaagtgctgggattagaggagtgagccactgcgcccagccccatctgtattttttttttttttttttttttgagacggagtcttgctctgtcgcccaggctggagtgcagtggtgggatctcggctcactgcaagctccgcctcccgtgttcacgccattctcctgcctcagcctcccaagtagctgggactacaggcgcccgccactacgcccggctaattttttgtatttttagtagagacggggtttcactgttttagccgggatggtctcgatctcctgacctcgtgatccgcccgcctcggcctcccaaagtgctgggattacaggcgtgagccaccgcgcccggctccatctgtatttttaacaagcatttcagaggattcttatcctcaattttgggaaacactgctagggcttacattgagattgtctagaggaagaggggagccctgttcatggggtgaaactctctgcaaggcaggaaatggtagtatcaaatgcagggtgttgttcactactgggccacacattaggatttccttgtgagcctttaaaaaataccaaagctcagggcccatctccaaatatttggatttaattggtctaatgaggagccagtatatttcaaaatctcccaaatgactctagcatgcggggagagttcagaatcacagttctaatgcaaccaaaggaaagtatctgaagaacataatgtgcagaaatattaagctactacccatgaatgatcagagactagggccatgtaatagggaaaaaccattaactggaaggaagttcaggggactcaacagttttgattaaccatgggccgggctgacttgaaaaatgtttcaagtctaggatagctgtttgctttttaaattattacagtaatggattcattgttgaaaatgaatgttggaagaatataaaaaagtacaaaaaacaaaaattgcttatactctttctactcagagatggttactttgatacatatcttctcacctgtgtgtgtgtgtgaggatgtgaatttttgaacagcctgggtattctactagatatctggtattatgtgaacatttcctgacacttgtagcacaaacagcagcagctgcttacacggtggttgctgtgtgctaggtccaagccatgtgctttctgcaaactaactcatttaagcttcaccaacatccttctgaggtagaagctactgtcaataccactctacagaggaggaaactgaggcacaggtgttaagtaacttgcttaatactaacatctactgggcacccatgctgtaccatgcatggtgctaagcatgccaagtgaattatttcatttcaacgttataattaccactacttcccgcttttacagataagaaaactgaggcacaggtaggttaaatgatttccccaagttacacagcctgcaaggatttgtgaaagagctctaagccaagaaatgtgaacctaaaacgctcaattaaccctgcattttacttcttccagtgtaatgaaaacgccctcaggtgcttaatgttcatggatgaattgtattccctcacacacacaggatttacttaaccctttaccagtgttggacattgatgtggattctattctaaaacactttgaaaaacactattgttcacaaacacgtgatgtaggtctcagatcatttagagtaagtccttagaaaagaagtgagtagatcatggggtgttgtgtgatgcatgttgtcaaactgaccttagataaactatccaatttatagtccctcctgtcgtgcagaggagagccggtcttgctgaaccttttcatccctagttattacaactatttttccccataacttctcactactttaatttgcatttctttgattactagtgaggtcgatttctttttccccatgtgcttaggtgttattatacattttgtggtttcgaatgattccagcaacacagtctgcttttcagctggtggcacagcagagtgaacacaacatgaaactgggaggtgcaaggccaccagttctatgcagcaacagtgcgtgaagcctggaagagtccctgctggggcctgggctgcaggagagcccttccaatcacagaggcagaaggctgtgggcaggagccctggtaaaaacttctatttttattgctactattcttattttggaattacctctttgccttaaaaggtaaggatagcccctcaaactctgtatccaaggccgggtgcagtggctcatgcctgttatcctagcgctttggaggctgaggtgggtggatcacctgaggtcagaagtatgagaccagcctggccaacacagtgaaaccctgtctctactaaaaatataaaaatcggccgggtgtggtggcgggcatctgtaatcctagctacccgggaggctgaggtgggagaatcgcttgaacccgggaggaggaggttgcagtgagctgagaccatgccactgcactccagcctgggcgacagagcaagactccatctcaataataataataataataataataatgataataacaataattctgtatctacttctaccccctgttaacttgttaggcagtcatttacagcaaagcttagttatgggctggaaaaccagaaaatatccaaaatcaatctgaggtaagacatttgccactgagcagcctcaatgcttctgtgttaacgacctgtacatggtataagacctgtactgtcttaacaccgggcacggtaggaggtcacaatttctgtgttgcttttgttgtcattgaaattatgttttgagcatttgggttttgaatgctgagaagactgcttcctggtcaggttcgacacagattagtcattttgaaagccatcgtcactggcccctctgcatagcccctttcctccctccctccccactttagctgagccaggcttgcagctccagaagccacagagtcctcccctggggactcctgtgtgaccgcccatcagtagcctgagaaatgctgtagaacatgaaccactgaaaagtcttcagcacctactgtctataggctcccagactctatagaaaatccaagggcaagacttaaaaactaccatgtaataaggcattacaattgttacaccccactgtgaaaggctaaaagaaatcattaggaagtatgcggttggtgctttgcatcagaaacaatctaccctcttacctctgctcttaggctgatggtgagtaggcttttatgaagcaccgttctcattcctgacagtcctgtgaacgctttcctggattgcatgactttagggaggaaaccgtaccgtgtggctttgacgcgtttttctcaattgatattcgggtttcacagtgtgcttagagaaggggctaaaatcctaaggtgctacttgtgcaagtacacgccacgagcataatcagaagacagataaaaaatgacagaaataggacaagaatacaaacagcctgtcacttcctacagagggagcgtggttggttttcttctccacccaaaaatgttacactatcactttaactttgtcaaaactgccatatataacaaaccaaaataactaagaattttgggttaaacttccttctgtttgcacaaggtgccaaaattccaatttaataaaaatacaggtcatccgggaaattttaaattatctactttgcaacgcagtccacatgacatagaaaactataaaccatttaattaataaacatctattttgtacctagcaagggctgggctctgacaggtgcaagcggactccccatgggggtcgctctggtagatttctccttcagacaagttagcaagaatggctcttctagtagcttcgctataggacgcccattaccagctaaaatgtgtactgctgcatagggtttcaaagccaaaaatatattttctgatatgtttaaggaaatgagatcaaatttttctttttagaaaaatgaaactaattatcttacattttaaaagacattaacaatggcacttctaggaaaacatgctgaacacattaacacagggtgggaaaaagataaggaaagcaaagtggaatgtgatcgcccagacaaattgtgtccatgagttcaatgggacaagcagggtctttacacagaattcccgggtgaacgggacggagatgaaacagaagttacacttgccaacagccccatctctcatctcaggagagatgaggccagcgaaacaactactagcaactgcttgggaaacatctgaaatatgagcatgtgaaaaacaatatgtttaacagaaaatgagcaagtctattcactgcatatgcagcagctaattatgagaaaaattaggagacagttctgttcattcacatgactccttctcaaccacaatggaaaatgatacccttcttttaaaaagtgattctccttagaatagcaacatttgggctgggcacagtggctcacgcctataatcccagcactttgggaggctgaggcggacggatcacctgaagtcagtagttcaagaccagcctgaccaacacggtgaatgaaaccccgtctgtactaaaaatacaaaaaattagccaggcgtggtagtgggtgcctgtaatcccagctacttgggaaaccgaggcaggagaatggcttgaacccaggaggtggaggttgcagtgagctgagattgcaccactgcactccagcctgggcagtacagagcaggactccgtctcaaaaaaaaaaaaacaaaaaaaatgcaacatttggaatgcctgtaaccactggctcacattccccatcttctcagtggcctccaaggtcctcatgagccacactgacttgttatcacccaggcagctgcagcctggcactgggcctgatacccaggagcacgggatagatgtgtggattaacttaagaaatcagccagaggcttgctgcctgcctaatgaactgggggttctgtgggaagtgagacaaacagttacccttccctcctccatgaacaaaatcctgagcctggtcctcccgtgggggccctcaaagtccagtcagccatgcttcgctgtggtcattggggtggggctggggaggccccattaaagccatgcctttatccagcgatcccttcctggttcccagatctgcagtctagcagatgcctgctgctttccattgctttccaaccctagtgtcatgttctagaccagtggatggtcatgacacactggcctagcctgttccttcaaaagcccctccccttccggaggcgtctgtatctaggcattggtatccagatacagaaactgaccgccaaggctgtaggtctcactgaaagagccaggagcagcgttctcctctggttggcagaaggggctttgggcatctctttagagcgactcacattcaccaaccccgctgtcaggtgcctaacatgcttctgtgatggcctcagccatgttccgctccagaatttgctctgaaagctctctgggcctggaagcctgcaatttcttttttcagcatgatttggtctattcagtataccaccccgtgcaaatatccctctgatacagggtaacgaatgggctaattttggaaaggggaaatctggggtccggagaagatgaagactgaagtatagaggttagcataaaattaaaggtcagtcagaaaagagaaaactgctctgaaaacataatggatgaatattactcttcagcaaagttcaatttgaacaagaattgtaggttgcgctggcagaatggtaactagaaaatccacaaatgcccagtcagactgctaatgcattgtcaggcctgctttttatgatgtcacaatgaatgactctagatgacaggcagtgcagattcagttaaaacataaagtacctggcggactatttctggaggttacagttttgttattaaaaaaaaatacacaaataatgggtctggaagaggaagcataataaatttgaggactcagaagtgatgctaaatttggacatttgaagaaggggcacaggaaagcaattcaaaggcacttgagttatcaacgtgcacagaggaaattaagtaggaggcatgttggaaaggcacccactgatatcgacctggatggaagcccctgaagtcgcagttcctccacagcatgggctttgaactcctgcgcttgggtctggcttccacaaagatgaactcagaatggaaaaattaaaaaaaaaaaaaaaaaaaaagttggaagccattgccactacagtgccaacctggccagccacaagaccataatattttttaaactctgacggctagaaatggacacaaattgctcttttgtggttgccagcaggtttctgaatcatctttgggttagggcttcagtagacttttgattttgcaaggtctagtaaagaacttttatacacacaagttaagtcggaggccacggtccaccggccccacccctgggactgggttttggggttgttgcttccttttcataaattagtaaattcacaactggtgctgatgtgaaggatggcgccagcttggaaactgtcatggtaattctagtagtgtttaatgcacgtaacaaaatcaggggctgggagactactcatgcaagggggcgcctcattgatgtggaccactgaccaacctacaggtagcgaagacaaagagagagccggcacggaggttcatgcctgtaatcccagcactttgagacgctgaggtaggaggatcgcttgagcccaggagttagagaccagcctgggaaacataaggagacctagtctccacaaaaaatttaaaaagaaaaattagctagatgtggtggtgagtgcctgtggtcctagctactcgagatgagcgggaggattgcttgagcctgggaggtcaaggctgcagtgagctgagatggtgccactgcactcgcctgggtgacagagagagaccctgtctcaaaataaaaaaaaaaaaaaaaagaaagaaagaaaagaaaagagaaagagaaagagagaagagagaagagagaagcaggatggagcaaagggatacaaatgaaggaagaagggtataggtccatgtggaaggagaaggaaaacaataacctggagaaaaggtaggtggagcttgtgagggctcctggggcagccgccagctgcgtgtactaatgtgtccccgatgaaggtgctagaacctctcactgggagtcagggtatctctgaacaacatccttcctgcaactgcacttctaagggaagaaagctgggtcataaacccctaacccccgactcacgccagctatttaaatgagcccactccttttactgattaacatggcaaggacgcactgatgccttctaatgaatgtaaaggcaagaagccacactgggtggcccttacttggaggcagactccctagagggccagatgctgacgcccctcccatgctaggatcccactgatagaggaccctgtccctccacatcaatgatcatcctgggagcatcccaggtcctacaggaagccacccctgagggtgttgtcacaggcagggacaggaagcactagagaaatggttccccacccgagtgactaggagaagtcctggtgactgcacgcagggcagacactgttccctcccacaacgtgaggcccttcccacctgatgggtgggcagctggaccggcctcggcttctgatgcctcatctgtactgcagggacagaatccttccttttgagttttctgggagggatgaaatgagataataccttcaaagtgttattcatcactttcttgtggattccctaacttgaggaagaaaaggtatagatggagaaaaataggctgagaaaacaatgtctgtggccagtccttggggagccggatgaacctgcagttgacacccaaagacggctgcccagggtcaacggaacagtccaggctcggggcacgtgcagaggggtggtttctggcttctcatcacaccaacagggagcagtgttggaacgttgccaggagagtggtgagcagctgccctgggcactggaggggcggcgtgggtttaaaggccaacaccacggctgtccagtggaacgctgtcggcagcgtccttaactgcccctgcctctgatgcctcatctgtactgcagggacggactacgccttcctttttgtatcctgggaggaatgaaatgagatgatacattcagagtgtttagcacagtgcctgacacataagaagcccttgtttcatttggtattaactcaattaaaatacattctcaatggagtaggttatcttgaagctctgtttgcttgatcgcctggggaagggggtgcgggtggcacacaggaaagggtgaagaaccgagtgtctgtctgaaggtgatgattatttcagatcggcattgtctttgtctaagctgtaatcaacaggccttcacaatgccaggaaagagtgacgtagctgactgtcatcacaagacgctgctcctcctggggatggctggtctctgatgaagaagctacacccatttccacaatacggatgcagaacaaaccagtatttcatttattaaaacaaggcaggaagagaagctctaatccattctctctcatgcgtatctaataggtaaggcagattatttcagtattttcatattttctctttaataagggcatgtcagatttttaccatgttaaactgctttcaccagtgtgaaccacagagtgccatgatagacatggagaaagaccagcctcgttctcatttgcctttttctagcaccactcttgctttcatttacttattcatttattcaacaaatatttatggagtattcgcggtgcctccgacccacggttcttcagaagccaagatgagggctgtgaggagcagaaaaggtggtcactagtcatgggtttctgagagcctgaaggaccctgcagctgggtctctggtgatgacaccctagggaggccgcctaaaggccccaggccccatagctgcacagcggcccaccagtgacacccccagtccacaacctgtcctttgtcgagaacgcagaggcacagccatctttgaggcaaagcggctggaccagaagacccactcgggtctcttttggacccccgtctcacattcctacccttggtgtctctctgtggggcatttcttagctctcagactcatccagttctctagctgaaggcagaattccacacgaacaactctcctcttggggatggcataaccagcaagatgcatgaggccctcggcagtgctgccgctggatcttccttgtcactccagaagcctgcacctccacaccactgcacctccagaagcctcatgttcaaaggacacaacctgctttttagtggggaaactggtgctggtaaaagctacatggggcacatgcaggagacaggaccagcttccaggcgcttctggaagtttccacacttacgaacgagaccaaggagaagggcatacagaagacagtgagggaagaggcggcctgtgtcttcctggtgttcatgagcatgccagccctcaagaaagagaggctttgcctcgtaacaaggtcaaaataccaacagctaatgcttagtatggaaacaagcagtgaaaaggcaaatcgtgtttgaggattcataagtttgtaaaagaaagaggaacatagaaacagatgttaaacttgaagcattctctgtttttggaaaacccttataagcaggatatgatttaagagaagctttaaaagaccctgaaaatgaactgtttaccatatccagtagcactatctagaatggatgtttactgatcaaatagaaacctcccaagatgagggccccagaccaccacatcagagactctccctaggttgctaagtctctcattagttacaactgccgctgatgacaggagataattacaagttattctcatgggtaactaacaaaaaaatcttaccagaattcctggggctatgcagagaagagccaattatggtataactttcagcttcaaacctctgctatgttaagtgtattttacagcttcctctgattataatatttcaaaggaaacacattaaggaaaccctgagtgcctgataacagccttttacatattttaatggtcgttaagtattatttagttttggctacttgtattttaagcatgcagtttcctccatgtgcagataacacagtttttcctctttgcctacttcctcttactgtgtgtgtgtgtttgtgtgtgtgtgtgtttcagcaggcaagctttggacatggcctgtgagtcttttcctggaccacgtcagtgcctttcatgcaaagcccacagccagtttcatcactacagtctgttaactgagaccatttaggagcgggctagcatctagatgagctctctatggagtcaacgacttaaaaaggggaaaatgccaagtctttagtgttatttgtcaaattgtctgtgaagagaacatgttttggggtacacagggagtccctgtggcctggaaactgtcctcacccgcagcacctgcagtggggaaagctcaggcacccatgcctggtcattccctcctccccatccaacctacctctcccttgtccagcccctcccctctgatcggagcggggagacaccctaacccagtactcaagcatccaccggctgtctgaaactcaattttttcaaaagtttcaactaagagatgcgggcagttgacagcagtgggttctgaagctaagccatcaaggggagcaagggcggagtctaagtctctgccagccagaggtacggggaagcagaagctgtcagggaagggaagaggagcaaaacaagtacccggagacgcacagatgggtggcaatgggaggcagagatgggtggcaatgggggacagagatgaatgagtccccaggggaataacccacaatccagggggacaccttctcattccatttctaatgaggccagccagtttttctccatttcctatgaatggtccgtgaatctctccatgaatccttacaacgacccctccctttcctttcaggtaggttccacttcctgcctcccaaaggatctatgaaggagggaaactttactgctaggaagtcttcagcctgggggcaaggagggcccctgagccaggggtcccacagtcaggcttcacagtccatctgctgtgctttaaacgctggtaaagttaccagtcatacgaatgatggcccaacacgttaacatgtagcttcaaaaaacaattactgtctactcatcaatttagataaactatgtatgaaggagaaccaactcttggtccttctccactacttgcacctaagagatttttagcaagttcacatgctcctttgtctttctccccaacagaattgtcattcttctcctgtcctagatgctcagtactacttgatctgctaatagtgaaagctcaaagcaacagccccctcagcacattaggaaacaagtgtcctgtatgctcaaaaatctcatcaaagcttcatgtttgtgttttgttttttttaaagttttactagaagtccctcgagtaagaaagggaaaaagaaaaaaaaaagtaaaaaaattttactagatagagctggtctttaaatcagaaactctgttctaaactgatactaatcattacagggtaaggaacagtcctgaccattctcaccagacaatgctgatattccagctaagccccagatgatggataatcctgccttccatgtatgctccctttacaacatccacagaagagcagtgttatgtgcattatctcgtgtagacaggtcaggatgcagtctttataggcctctcccagacaggaaagggacacagctgggctctgagagctgtcacacgtccatgcatgccagggggagggtggaggacaagggactgagaaaagaccatccagcgatggtaaccccaggagctcacagaatcaagtgctcctttcaaacgaaaacaggcctcacctggggagagctcagccaggcccagtgctgctgcagggtggcagccccaaggcatctggcagcccggggggtggggaagttgtggctcaagctgggctccctccattgctgcactgagcagccattgatggccagtgacatcctctgggctttgtgttggctatggtttaaatgtttattctgtctaaaactcctgttgaaatttaattgccattgtaacagtattaagaggtgggacctttaagaggtgatgaggtaatgagggttccaccctcctaggtgggattggtgcccttataaaaggatgagttcagccctctcttgtttgatctcactctctcaccttccaccatgagatgacacagcaagaaggccctcatgagataccaccaccttgaccctggatttcccagcctctagaactgtgaactgataaatttccattcatcataaattacccagcctgttacagcagcacacattggatgaatgcaatgttcttcagttctaagataataatattgccaacatgcctaggtctccactattctgtcagaataaaacaaattttcattcagcccctgtggccttccaaatgaccttgatctccatctttcccaggacatgagtggggtgttgaggactggctcaaagtgtggggacacactttaaggcagccctcaaccaagaaactgcagaagaggaactctcgtgacccttcccaatcacgctgatggcttcaagttggacagggctatcccgggccccaggtaccccctagaccgggaggccagcccagcagaggtcactgtgtgggatggaggaggcagcaagaccacagctgtgcttttgagtaaccaaagactgggatctgacagcaccatttattcatcagattcagaattcacataagccatagcagtattggcttttttttttttttttaaatttaagctgttaactattgacacctatttactttttcccaaagcactttgtttctgatggggaaaaacaattctccttcatgcctacctttctgtttccctccaattttcagttctctattgggcacctaaaaaaaaaaaaaagtctttcatttcaacccagggaaccttgcagccagtctctgaagcttggggcactggcagggatgtctgcaaacatgtatgcatttgctatttctaccctaggagccaaccttcaatccaaaagccactctacaccatctaagtgaatcggccaatctcaacaacatggacaagaggccagatctgtcgagaactctgtcatctgtatgaaaacatcccagggctacacaaagccacttatctgagcccttcactcaggatggaaacaaaggcagcttgcagatctgattatgccgtagtcctcaggaacctgttaccacacaaggggctagaaagtcctgagcgagttgtggatgaggttggcggccacactgcccacacagaattctaaaggggattctcctgcctcccaccgtgagactcaactctgatccagcccctcaaatttgagggagaccccacgtaacctacatggtccatctgcagggattccatagccctgtctttacttcattagaaactgaccgttctgcttttcaacagttgctacaattggggaaagaataaattgagcacatgagcatgtattaaataaccatatatgccctgtactgtaagactctgtacaagaaacaaaagaaataggagacaaggtacaatctcagtaccttgatatccaagttggaaggtacaaatatactcagcagaaaactaaatgaaaaaacaaaacaaaaacaagcacccgtttgtgtggtagtcactaaggttatctgaaccctcagacaactcacccataagaccccttttccagctccatgctggaaaatggcagccaagaaagtgaaggccttgacagtagtcgacagaagtgtgagttctgaagcacaaggtgaaagagaaacagcttccagccccttcttcattgtgattttcccccctgagcctggctccatcagtgctaactcctcttgctcctcgctggagaagcatctgacttggcaacttaaacctgcttttactacgctgggcagaaacgagggctctcacctttgcttttctccaataatgtgttaagtgctctgactaaaaacaaaatccttcccatttttgcctgaaaactgtcaaccaacaaggaaggtcctttgtctgcaagggtgacctcgaaccatggaaggcgagttcattcccatcagacttgcctgttttgtgtgtttgtttgtttttcttaaagaaaggtccctgattccgtctgtgtcctttgtccatatctaactgctgacatgcagttacataacacgctctgtagactcagagctcttcctccccaatctgtgcctggtcccagtgcagcactaaaggcaaacacagtgttaggaagggatgacaaaggtttcctccaggtggaaaccgcctgggagagggtttcagggctcctctcccagcctggctctgtggcaagctgccgaaattctctccttttttaccatcctgttcccctagctaaaccgccctctctttttgttgtaaggaaacacccacagatgcagctgtattcagatgggatgcccacattagggccagtgtgcgtgcaaggaaaagataggtcagaagccaatggaatgatatgaatataccagaagaaacgttttgttttacaaacggaggggaatacagagcccttttcactctctgtaacctgcaaaatattgaattgtgttaataagaaagccaaatatactgtgaatgggtgcgtggttgtgaaatagcttttacaaagttctaaaatgactcctatctgaggcaagatgaagagattacaagggaaccaagaagcagagtcctaacacatggcatttagcatgacagaatgtgtttactcactgctatttattgaaggcccattatggccaagccctgtgctaagtgctgctggaacaccctgaatatcacagtggaaacaagtgatcttgggctgggtgtggtggctcatgactctaatcccagtgctctgggaggctgaggtgggaggactgcatgaggccaggagttagagatcagcctgggcaacacagtgagactctgtctttacaaaaaataaaaattagccaggtgtggttgtgtgcacctggcccagctattcgagaggctgaggtgggagaatcacttgagcccaggaggtcaaggctgcagtgagttatgactgcaccactgcactccagcctgggcaacagagtgagaccttgtctctaaaaaaggtggccgggtgcagtggctcactaatcccagcactttgggaggcctaggcgggcagatcacgaggtcaggagttcgagaccagcctgactaacatggtgaaaccccgtctctactaaaaatacaaaaattagccaggtgtggtggcacatgcctgtaatcccagctactcagaaggctgaggcaggagaattgcttgaaccctggagacggttgcagtgagccgagattgcacaattgtactccagcctggacgacagagcaagactccgtctcaaaaacaaaacaaaacaaaaagcaaaaaaagtgttcttgtgtctaataccatttctccctccttggccctggccaaatatagatttgaaagagtttacctacacatcacccaccgccaaactcctgagtcaaaagaaaacggtgggttcacagtgaaacttaccccgcctccgaggttctggaagcagaagtgctctggggctccccgtggcctctcggtgtgctgcggcggctttcggagtcactcacatgtcctttccccgcggacgtcttacgatgtgcgagggccgcagggccatcctcatgcccgttctgcaggccctggcctgctcgtgtcccagtcctcgctgcctggcgccccttggggttatcctcgcgtgatgctggggggtctcttgacagcttgtatccatgagagatcaggaggtcttctacactgtacatgatgcctgggcttcagcaaagctcaaccactggaaccatggtggtggcaggacccagcactgcaggacaacagagagctctatttgtgactaggtctccctagaggtcagtctgacacctcctcctcccgtggtccccccaccaaaccagaccatggcgatggacacagcacagaacctgcacagaaagaggggacacagggatggctctgcctgaaattactctccattctattcacctagaaagtgggtgtggctctgactctaaatgatgtggtggaaccctgaggacctcacccttcgatggctgcctctggtagaagagcatgtggcacggtgcttaagcagtgacatgattaacactgtccaccttccccttgtcccactcacctacaaacagcaggcggaaggagtgcggacaaaaaaaatacagacctgggagctgcaatgactgcttcatgtttctaaaaagagaaaccaccaatatccagcttaatcttaggacacgcccctgctttcatcttgtagacataccttctgctctaggagagagtgagatctttaatcaacacagtcatgatacaattcagcggaagccatcgaaacagcaactgccagggcagccaccccggggcagttaactagcaaccaaaaatagattttaactctttgggttcatgacgagaaaacaacacactgatcaatcatacacacccaattcactacacaagcccagagttctcttttccttatgaaagtctttttttttttgagatagagtttcactcttgttgcccaggctggagtgcagtggcatgatctcgactgcctgcaacctccacctcctgggttcaagcgattctcctgcctcagcctctcgagttgctgggaatacaggcatatgccaccacgcctggctaattttttgtatttttttgcagagacagggtttcaccatgttggccaggctggtctcgaactcctaaactcaggtaatccacccgcctctgccttccaaagtgctgggattacagccatgagccaccacacccggcctccttatgaaacttttatgaatcaaatttcttcccagtagatcttggggaaaagtttttgcatctctcagccaaggatgtccacacccaaatcctgctatagtacctgaatcaacagcagcaacttcctccagtgtaaactgcacaaaacaagagtacccacaaagaagaatgaaaatgggcagaaacctacctacgagcaaaagagggagagccgccctgtttattcctacatgagaacatctttcttcctaagtcttccctttgatgataaggcgtaagacggattggtcagacggatacacccaccactgcttctacgggggctgatggtaatgctggcctgggtgagagacacacaaaagccacaaaagccagccccatcaaaaagctcagccagctccaaccccacttcactggtggacggaaatagagccgctgcagccatggcgaacaatggccaggaaacgcctgctggcccgtgtgcaggtgaaaggaagatgcctgcggcatgtgcttcctgtcactgggagctcttactcgggtctgtcgcacaattctgcttgcctgtcctcactcttcatcacctgctagattacagtagggaaagtctcgcctgtcagcatggagagtatcaaactttggaagttgataattttccattatgtccctacattttatggaagctgacaagctctggcagctactgtactaatagaaaaatctccatagcaactctgccactcctgacactcctactgcatgtctttcaaggagttgtacaacttgggtcatttgcttcaacagacaaagaaggaccagagaagcaagggtttgttctttaattcaacagagtaagttccaccatgggagggattacagaggaatgagatcccatcacaagcaaagggctttaggaacacagagtcaggctttagggcagggtctttggtttgtttgatgctttatccccagcaacttgcacacagtatgaactcaataaatacttgttgagaaaatgcacaaatgagagacagaagtgtttgagctaggttttgaagaatggttaggagttcattaggcaaagagcatgtgtttgtgtatgagaaggggaactggcatttaaaatagattatgagtagaattatcccaagggtaaagaaatggggccaggcacagtggctcgcacctataatcccagcactttaggaggctaggtgggtgaatcacttggggccaggagtttgagacaagcttggccaacatggtgagagcctgtctctactaaaaatacaaaaattagccaggcatgatggcaaacaccagtaatcccagttactcaagagcctgaaggaggacaatcgcttgaaccctggaggcggaggtggccatgagccaaaatcatgccactgcactccagcctgagtgacacagcaagaccctgtctcaaaaaaaaaaaaaaaaaaaaaaaaaaaagaaagaaagaaaagaaattaatggcttagtaacagaatcctggcagactagaacaaagtccccaggctcactggttcaacatcacacacagggtcagcatcacagttaaagttagcattaggtctcacaacactcagtttctctctcttactatgccgggctctttaaaataaaagcaaattgcactgtactccaaatggccaccgaatacactaaggaacaggcatgtgcagcacacagctggttgtgctacagtccatttgtcagaatggcagagaagacataaccctcacaaaacacagatgtgggccattttcttcctggggctggataggttggtccaatatggttatgtgtttgcatggtaattatatttagcaagaatatctttcaatcgtagttaactgattcttccctccccaccagcccaataaactcttcctctaccaactccaaggaaaaacctgaactataaacccaggattgcagcacacatgaaatctaataacatcaactattcatgaccatctgtaatgtgctagattctgtactggcacactttcattcattctatgcttccagcaaacttctcgacgtagacaggaatgtttccattttcacaagaaaactgaggctgacagtccaaggttacacagcttgtgttagatccatggtttgaactgggtctgtctagcttcaaagttcaggctactaatttaggttcactcatctatattttcttccttaacatcaaaaaagtttcctactttaccaaataatccatacacataaataagctaagagagaaggcatggtggcattaaaattaaaaaccatatatttaaaaggaaaaaaattctcctttattctctaggagcagaatggctcttctagatgactcttctcacacaccacacgcacacacgcacgcacacacgcacgcacacacacacacacacacacacaagagttgatgcctcacttggctataatgtcttgatggcaacgctggtgttaatgtttaaatgctcagtaatatgattcgttcttgaatacaccatgcaattgccttgtgaccttaacagacctctttcatcatttggagttttgagcttttcataaataacatggggctatcataaagcctgctgtatgaaactgaaatgtatacaaacgacatctataataagtgggagatgagtaactttaaaaaaataaattcttaaagaaaaaaaaagtcctatatagaaatagccattcttatctgcaacattaatagaatttggacttaatttgaatagacaacagcaaactacaaatgggtttgggcaagggaaatctggcagaaaagcaggggactaaagtggatagagcgagaacagatgggggacctgtagttacaagtcctttctattgtaacatgcacagggggctggcagaggggataagaaaaaaaaggaataataagagtaattttcaggagaagaagtacaatggattttagcctcagtgacgaggataatgatcattccattaatagaaatatagaaactgaaaataattgttggtttgagaagatgacagctcattttattttgatttaaccaacctagtctcacaaaattctcttttccccaaatcatcaaatggattctcatcaaagattaatgatttgtccttccaaagaacctgaataagaccacttgcagtgatcttattgcatggcaccttttcaaagttctttaaatattagctctatggtgtctattcaaatggaagggattatagaattaggaagttgctgttaacgatccactgacattgggcatggggctgggttacctcccgcttcgctgttgggatgagtgtctgtttctccatggtgcacggtatttatctgtgaggtgaatcaagcctgagtcactgcacaggaggaaaggagagaaccctttgggtctcagtcttctcctgaaggagtaaaatgagaaggctgaactagaggttctttagagtccttctagctctaggaagcaggcccctttctctagcctattctcgcctgtgatgagcagcaggcatcgaagtcagctgccccaggaaaaagagtacagcttgtggccacgacacagaacagggctaaataggtcatctgaagacagaacctctgaccttggccttattagcacccatgcagaggccacccaagagagtagggataaatggccacccactgaggaaaggagtgggctagggaaggcaggccaggagcgaaacatccagcaattctccatcccagagtgcgggtgctgcacgcttacgccaacgtaaattcatcagggcacttgttttacattggaagtgccaggcactgggctgaagaatataaagacaaataagaccccgtcagcaccctcccttgcgatgctatggtctaggtggtattatttcaattacggatcttctcatcactaaaggttaggactggcaaatgaatgccatttaacaggtaccatcttctccttcctttccatttataaaaataagcattttaattctcatatttacagttataatgctcaagacagtgaaaggaaacaaaacattaaggaactcattaaatcaaccagaacttttttcctttttaaaattggcctagaacacaaactaaaaattaactttaaaaagagagacaaatatactattaaaaagatgaaaagcatggtcaccctcacctgtaatcaaagaaatgcaaattaaaccaaaatgccattattcacttatgagatgattaaagcttttaaaaagcaatgcttgttgttggtaagggcatgaggagctataagggttctcctgtttgtgtgtgtataaatggtggggggtggggggtgcaggctatatgtaaatgaaaatgagtatttcccttcttaaaagtgattagccaggttcactggctcacacctttgatcccagcattttgggaggctgaggcaggcatatcacttgaggtcaggagttagagaccagcctggccaatatggtgaaaccccacctttactaaaaatacaaaaattagccaggcgtggtggcgctcacctgtagtcctagctacctagtaggctgaggtgggaggatcctttgaacctgaggtggaaactgcagtgagcggagattgtgccactacactccagcctgggtgacagagcggatactctgtctcaaaaaaaaaagaaaagaaaagaaaagaaaagaattattaatatgtaacaaaatctttaaacatctgaaaccctatggaataatctcacttcttaggatctgtcctaatgaaataatcagagatacacactgttttgtataaggatagttatcccagttttaattatgataataacaaaattagactaaatgtctaatttagtaaaaaaaaaaaaaattctgggccaggtgcagtggctcacacttgtaatcccagcactttgcgaggctgaggtgggcagaccacccgaggtcaggagttcaagaccagtctgaccaacgcagttaaaccccgtttctactaaaaatccaagaaaaattaggtgtagtggcatgcgcctgtagtcccagctactcaggaggctgaggtgggagaatggcttgaacttgggaggcaaaggttgcagtgagccgagatcgtgccattgcacctcaccctgagcgacaatgaggctccatctcaaaaaaaaattctggtgcatccatatagtggactataatatgtatacacatacataaaattatgttttcaggtatacaacagcacagggaaatgctcgtgataccacgctaaataataaagacaggatacagaaccctagattcaatgtcataccaaatttgtttatatacatatgtacttgaaaggggaaaaaacactgaaaggaaacataccaaaatgtcagcagaggtgatggactctgagtttttgaaaaatttccttatttatactttactgaatcttatgatattctgtcatgaaatgtattaggtccaatcatatgaaattgtcattttgcaggtcaaaaatagtcaaatattggcaatttcatatacttactatacttaactttatatacttaatattaacttaagtatatataacaacatatataatatccacattcttattatataatttaatataacaatattgtttcatcaccaatcatcattattcataacttaatatattaacatattacataacttaattaagttatatataactatttcatcatcagaaaaaaactttcataaatgaaatgctgcttaggttagatgaggaaaatgcatctttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccgaaaatgcatctttaaaaataggttaggtatttggaagcctcaatgacaataaaagaaacattgaagaaaagaataaatgagtagtaaatcacataaggctctagtatatggtacatgtgccttatctgccagagagactcttaacctgttttcaggaagccaaaatcacatgtgctgctgaagaaatctaatacaaggttacaaccagcattctaaaaaggtcttaattagacattgttactcctctaaaagacctaaaacttttcagttgtattcactgacattccatgcttaagatgtaattggtccctcaaattgttggcagttcagtgtaaatatctcttcaactgacaacatttaggtctaatgctatgattaatatataacaaagtactttctttaaacaagaggtaaatcaccaagacataaaacaaaccagaatggagtatgttgctaactgacacgtaggtttttaatgctttccacagattttttcctaagggtagaattgtgtattttactatgaacaatagaattgctatttccctttccagtcttaattattaaataacgcaacagtcccagttgaagtcctgggacaccaagttctcacagactgctgttaccataccacacgtgtgatgaccaactctgccaaggcagtcaagttgttaaaatctcacaagatgtaaaaaatcatacttaatctgtgaagtaatcattttaggaggacatccttaggtttctttaaggtgacaaaaaacaaatgagttggaaaacttgtgtctaagatcaaaaggaccttggaacattaatcttgctggggtggattggtattaaggcatttgttcaaaaaaagagaaagaaaaagaaaaaagtccccaacattatgcactgaatttttttcctaagtattatcccttctgactcctcttttttttctttccacaactaatgtgaacacacacacatgcacttacacacactctttctcctgtcttctctttcacctctaaattctgtgtcacacaattattgctttggctagcaatatttttatgagaccttaagtacctcattaacatttctgaaagattagaagtcattaagaaaggactcaaactggataagatttttaaatcttttggaatttttggctatttgcaaaaatagctgtaaaacatcatcataggttagagttttattcccttatcatcatgtatgtcaagctccacatgtaaagataccttaaatattccattaaacttacccttcttttggttttgtttttaaatatcttcagaataaaaaaaagccaagtctttatcaaagtgtttgacttaaattatttcatatgatctttacatttctatttatttcctaagtacaaaagtcatgtaaagtgatttcaaaagtaaacactgcaaaactcagtgcttaagtaaaaaggaaaagttcctagtaaccccactgtgccaagagataaccagtagcaacaatctggtttctgtttctctaactattcttcctacacagacaagttgcttgcttttttttttttctttccttctttggaatgtatcttggtgcttcttcctaatagtatctaaattctttcatttacatacagaaaaaacaatctttacaggtaaactataaagacaaccaataagcccaaaactataaggatacttcacgatctgataacaaatctgccagcctattgatttaaccaggctattcccaagcatatctatagaaagttgttgggaaagatatttggttatagataatccaaatttttaacaagacatcttcaattcaaatcaagataattgaggttttagtatctgggggaggggttcctgtatttttctaaacaccatttagtgtttaaagcatatatcaaagcccaacacctcccctccctgggctgctggcgtttgcaagtcagtggacctcaacattccttccatcagcaggcccttgaaacaaagcacaagagcaaggttttaatgagagagataacccttctcatccaaaggaggaaaaacaacatctgttaaaaacccaagtaaactgcagtaatgggttcagcaataggcccagaggacttcagagagatagtctttgcttatcaaaataaaaaacacaatagaacaattgtttcactccaacgctctgtgttctaaacgctctccagattaattagcatggagtttcgccaagctcattaaaagaaaaactaaggactcctaaggatgactggtgtttactgtcctcccaaactggccagtgagaacttgggggagccacagacttctgggctttctgtactgataacatttctaggatttatttttaaattgcatgttaaaaattagactacaagaatcttttcatatttactttttttaagtgaaaaaattggtccttatttattttccttgtgtacctccaaccctgctacattttatagctgccgaacaatagaccacaggcttctggaatctgtgaccactcgatgagctatttgataaccctgatgactttgtcaagtcatccagagcatgtggacactcaggccaaacttcttttttccccgaaacaggctttctccacccacccaaatcccctaattctcctgggcctgccaagggcctgaccttccagtctctgcagcaaagggtgaagttttacaggaggaaggcccagcagattaaaggcctctgttcaacaaatatttgctcgcccactccaggcggagtaacagtttcttacatgctgcatgcccacagtgacacttagagacttcaggaagcttgttaagctggtgactaagaattagacacctaatgtcaaggtaaataattaagtcccaatccacagacgttatggaaaaccaaaccactttaacaaactcccaatgtcacacgaaaaccaacacaagtccaatgaaatagaatctgcatatgatttccaaaaaagcctgtatgcattcttgctttgccgggtggtcttaaaattctaaaatgaactgacattcccaaagttttacctgtacagcccatgaccctcagttcacaccatgcagactgcctttttttgccagagcatttctggctgcccgaatcctacccatcaggccccttcccccaaatccctgtattttgcaaccctagccctcaatctctgggttatctattccttgtaaatctgaaaagacaaaagaccggagaaggaaaacaagttgtgggagaaacatcacattaaactgtcaggacaggaaaccctgggagttgtgtggtctgcaccgccccacccctctccccaagactaagaccaagctactagatttggggagggaatgaggacacgggaggcgggtggagtgcgtgcgggggtgggagagtgggtgtaggtgtggggaggtgatgtgcccaagctaattcccccaaggcctctctactccttaagcgcgtggatgaccaaacaccagggcatgcccaggtagcgctggcctaaagttctcgtttttattttcttcttcagtagtgaaatcacagcttctttacaaatgcccagaagaatcccaggcgctctgcttcttgacggaagcgagaggggcgctttttagcagctagtgctgggccccactgtggccagggcatcgaggcaaaccctggcattttgggggtgaacggaccccgactggagacgggggaagtagagggtgcccgcggagatctgagcgcagagaccctaggagggcgggttccagatcccataaatgagataattaacgggatttacagcactcctaggcggggctcctgcccttctcccatcccacgcgcagccaggagccgggcggccccgggcactcgctgggaggcagctgcgattagcgccctaatccccagcgcagaccgcgcagagaccggagcgggagcggggccgcggcgggagccccccaccgtcccgggcagtccagacggccggggcagcgtgggaactgggacctcggggacccagcgcggcggctgtcagctctggggtgaggtccgcgagatctgggcgcgagggcgcgggaggggttggtggacacaggctggggagggcgacttcgagaggggagtgagtgaccccggccccccaggccctccgcgcgccgaggggcgacgcgagcgctaacgccagccgcggcccgcggtgcccgccccgggacccccgcgctccgagcggggcacctgaggggaggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagcggctccctcatgccgcctcgcgccgccaccgccgccgctccggccggccggggaccagcgcgacccgccccgcctgcagccgccgaggccgagcatgcccggagaaccgccgtccgccccgcccaccgcccgggcccgccccgcccaccgcccggggctgcctcctctgcgctgagggcggtatccaggccacgagcttcctaggcttttggggtccgcctgcgtgggtcgcgcagaaggcacaagtgagctgaccaccattccctcttttcttgtcacttgggtttgggccacgtcaaccctgtggaaatgtccaaagacacacacactctcacagatacacagaaagcaaacatattcatatcacacaaacacacaaagatgtatgcaaacacactcatatacacccacacacagatgcacacaaacacactcacaggaaacaggcgcacacaaacacatatacaggacacacaggtgcacacacagtcacagacaagtgcacacacactcaaatacagtcacacgcaggtgcacacaaacacacccatatacagtcacgcacagatgcagccaaacacactgacacatatacatacatacatgggaacacagtatggctatacacacacacacacacacacacaaacgcacccacataacacatcgatattatgaagagcagaaaacagtgatggtgacaacagcttgggatttacttctttcaaaaaaaagtctgaaggagtctggaagccaccttcagatcagctggcccatactctcctgtggcagaggaggaaactgatgacaggagcaggatttgcctacagggcaggggtaggaggagagataggaggaggtcagtgggagagttcagaccagaatgaacatttggggtcatttgggtaaccccaaacccactccatatttctcttacagcgggaaggggcagaaagattagactgctgcctgggtctgctcagggcgaacgttttcataattttggaaggcagacagaagacaaaaaatgtgaaatattgctgatgcattggggagagacagggaatgttagttaagtccacccagacaaaacatggatggcacagcagactggtgaccttgccaaattagttttcagaaaactacttagccacatcatgattttaggactgtatttgctgtcgaaacaccaataactaactttttttgctctattaccacatctgagcccttcctatgtattatttcttttaatcctcatcacagtttgatgatatgggcaccactttacagatgaggagtgggctcagggacgggcacagatggcaagctgcagaatctagcccaagaccctcgctctgaaccaccagagcaaggtcgtttctttgttctcttgaatcatatgttcctcatggttagtagcaacgtataatctaacacagcataaaagctaaacacactattgctggaaaagaacgaacaatgtaattgaatgttgtattgtgcattatcaggagtgcgtgggaggaaaccagatggtggcgataggagcaggcagcatgattaggggctcgagaaccaggtagctcaggtcccgggcttggcttctctgccactttctagatgtggtactttacttctgttagcctcactttcctctctaacaaagtgggggtaatgatggtttgcatctcataggagagtcatgagaattcaatgagatgatgccttcttatcacttagttcaggtacatgtaatagtcaagaaaatggtggccgggcatggtgactcatgcctgtaatcccagcactttgggaggacaaggcaggcggatcaccggaggtctggagttcgagaccagcctgggtaagatggtgaaaccccatctctactaaaaatacagaattagccgggcgtggtggcaggtgcctgtaatcccaggtactcgggatgctgaggcaggagaatcacatgaacccgggaggtggaggttgcagtgagccaggatcatgccactgcactccagcctgggcaatagagtgagactctgtctcaagaaaaaaaaaaaaaagaaagaaaagaaaatagtagctactaccattaacacttgtacagctactgctgtttgacttggaaccaccagggaagactttgaaggacaagtggattgtggctagggagagacacaaaggctgggaaaataggattcgacaaaatttaaaagatagaaaaggaaatgcagacttttttttttttttctggggagtcacagttattaacagcagtgatattacttcttgtcaaaaaagcatcattcgatgatggatttcttcaatgacttatagaattcctgtttctcctcaatttgccaactcaatgaaataactttgtcctggggtggagcacctctatgtgcccagcatggtgcagacacctagggagccaagtattcctgctagaacatttatcagtcagtgaattgagattaggatgtgtttccccacagaacaatgtcatattgttgggtttctaggtcaaccccatggaagttttataatgtacctaagggctgtagagttgcaaaacaacagagtagggttgcagtaaatcagaaaacaacactgattcaatgctaggagctaagctaaaccaaaccaaatcaagtttaataagaaattgtattttagcagaaaggctggcaaaggcagattcaattaggggaatgtaatgggattgaaatactggagattctagagaagatgacttcacaatttcaagatgcttgtagtttcttgaccctggctctttatcctaacatcctcatttcaaaatgtttggcttccgtctttcctcagtactgatgtatccctagccctgctctaatgttttcctggcatgactaaggccatttcaaacaaagaagcagaatgaaaagatggagagagaagatggtggtgaggctgtggatgtggggagaggggcaagcagaaaggtggaaagcttttctaaagatctgggaatagaattaacaaagaggaaagagggtgtattattctattcccatgctgctaataaagacatacccaagactgggtaatttattaaggaaagaggtttaatggactcacagctgcacatggctggggaggcatcacaatcacggtggaaggcaaaggagaagcaaaggcgcgccttacgtggcagcaggcaagagggcatgtgcaggagaactactctttatcaaaccaccagatctcatgagacttattcactatcacaagaacggcatgggaaaaacccgcgtccatgattcaattacctcccactgggtccctcccacaacacgtaaggactattacaacccaaggtgagatttgggtgggacacagagccaaaccatatcagagagtaaggttgaaaagatgcatgagtatgagcaggtgattaatcataaatgtaggaagataataaagataaaaggtaatgaggaaaatccactgggccagtttccacaccggtcaccagtacatggacaagggatggtgggcaagacgtgagagaaacaagcctaacctcctaattcccttatccctacccactcccattttcctgcaatttgggtctcttgcttccacttacttgatcttgggagatttaaacacaggaaaaaaaaaaaaactcgcttatgtgatgtaaaatataaactatgattgaaaacagcatttaacatgaagctgttagaagtctggcacagccctgggagcatgtgccaggatccagccctggatgcccaatgtccccgcctttcttgagtcctggagaagggatttcacagactcaggaaggaacttggattattgagtcattgggcagatgtgcagtaaccagaaaaataatgtttaaccgcctgcttaaagaaagaaaaaaaataaaagccaagatcttgtttctctaacttactgcctgttcaaggacctagagcaaccctcctccctccctgctttagggcccttctctgtagactataaggtttcctttagctgatttagatattgattttgtttttcttagtctgtaaagacactaccagttctcattttttaaaagattaacgctcttttaaaaaaaaaatttgttgtcttcactgacacataataattgtacatatttatggggtacagtgtgatgttttgatgcttgtatacattctgtaatagttaaatcagggtgtttagcatatccatctgctatagtttgaatatttgtttcctccaaaactcatgttgaaacttaatccccaatgtggcagtgttgagagatgggatctttttttttttcaagatggagtcttgctctgttgcccagcctggagtgcagtgtcgtgatctcggcttactgcaacctccgcgtcagggttcatgcaattctcctgcctcagcttcctgaatagctgggattataggcaagtgccatcgcacccagaaaatttttgcatttttagtagagttgggttttcaccatgttggccaggctggtctcgaactcctgaccttgcgatctgcctgccttagcctcccaaagtggtgggattacaggtgaaaaccattgcgcccagcccaagagatgggatctttaagagatcattggatcctgaaggttctgccctcatgaatggattaatctattcatggattaatagattaatgggttaatggattaatgggttatcatggcggggaactggtggctttataagaagaagagagacatgagctagcatgtgagcatgctcagcccctcaccatgtgatgccctataccaccttaggttgactctgcagagtccccacctgcaagaaagctcttacctgatgcagccgcttgaccttggacttctcagctacaagaaataaatttctataactgtaaaaagtaaatttcttttctctataaatgacccacctgcgggtattctgttataagcaatggaaggactaatacgccatcaccttatacatttaccatttctttgggttgagaacattcaaaatcctctcttctagcaattttgaaatatacaatacacttgttagctgcagttacccttctgtgagatagaacaccagaacttattcctcctaaatgaaactttgtacccattgaccaaaaaaaccccacgttctctcttttttttttttcttttgagatggagtctcgctctatcacccaggctagagtgcagtggtgtaatttcagctcactgcaacctccacctcccaggttcaagcagttctcctgcctcagcctcctgagtagctgggattacaggcacgtgccaccacgcctggttaatttttgtatttttagtaaagacggggtttcaccatgttggtcaggctggtctcgaactcctgacctcgtgatccacccgccttggcctcccaaggtgctgggattacaggcgtgagccaccgtgcccggccaaaaccccacattctcgataaaaccttgaggtctctcttgttggcttgttttagaaagtcaggcaatagtggttacacagaaactggcaaggatcttgtgaggatagagagtatattggtgggtaccagaggccaggaagggtgggtttggataaaaagaagctgattaatacatacaatatacacttagaagaaataagacccggcatttgatatatcagtacggtgtctatagttaacattaaccaattgttcatttcaaaatagctggaagagaatactttgaatgtccctagcataaagaaaagataaatatttaaggtgatggatgtccctattaccctggtttgattatatgaatttatcaaattattacatggatcctgaaaatatctacatctaatatgtattaaataaataaataaaaagctgccaaattgaaaaaaatctagaaaggattttatgtcaacaagtgctaataacacttgtttttagttattgctatgctttatattaattcacagactatatcgcataattttttttttttgacatgaactctcactctgtcattgaggctggagggcagtggtgtgatcacagctcactgcagccttgacctcctgggctcaagccatcttcctccctcagcctcctaagtaactggactatagacacacacaaccatgcccagctaatttttgtatcttctgcggagacgggctctccctgtgttgcccagtctggtcttgaactcctgggctcaagcaaagttcccaccttggcctcccaaagtggtgggattagaggcatgagccaccatgcccagccctgcataattatttttaaccaagaactagaaatctgtttctcaaagtctgctccatggaccacctacaccaggatcaactgggggagggagagttgactaaaggccaaattcctgggcctcatcaaaccgatgcaatcagaatttctaagttctacctttgagatcctggaatgtgtactttaaggaaatgcccagatgattctcacatacagtaaagtgtgagaagcagggatggagcacaataaatagaaatgatctgtgtcaagagaggaatggattgattgacacgtagtatacagtgcaaagacagtagccgtgaacgtcattgtatgatgatggagagtcacatagcaacatccttcactaatcaagtgcattagatgtttactgttggcttagaagatttgacgctaactgaaacaaaacctacaatgctggggaccaagaagagagtgacaaacaatttttcaatcctatacctccactgtgaggagattgaatctgcatagttactgcatgagaaaaatcatttctaattgtttgctctcctcgtgtcagcttgttctcacgtaaagccacatattaatggaaaacaactctgttacactcaccgtagcaaagagctgctgtttactagtggtagaaagacattccaagcttccccctgcctgcagtttataaaattctttgccaaattcataaggaggcctcttgagcggtggtgccctccagggaatggcagtggctgtcagggatcccgctggtaccggggggatgccaatgtggcttcaagcagacaggggtgtggccagcaccagagtggtccagacgtgggcaccccttgggctgcctctcccaccattccataccagctaatcaagaataaatcaaaattaactcaagcattttttaaccccatatgactttttgtttttaaaatgggaaataggctgggctccgtggctcacacctgcctcaagtgactgaggcaggcagatcacttgaggtcaggagttcaagaccagcctggccaacatggtgaaatcccttctctactaaaaaatatgtgcttgtagtcccagctactcaggaggttgaggtacaagaatcacttgaacccagggggcacaggttgcagtgagccaagatggcatcactgcactccagcctgggcaacagagtgagaccctgtttccaaaaaactaaaaaataaaaataaatggccaggtatagtagtacatgcctatggttccagttactcaggaggctgaggtgggaggattgcttaagcctaagagttcaaagctacagtgagccatgatcatgctactgcactccaacctgggcaacacagcaagaccctgtctcaaaaaaaaaaaaaagaactatgcaaataactgtgaactacattaattgtaaaaagaatgcctccatttggggagagaatggtgtatcaggcttttattaagtcagtgatgcctagcaatacaaggtggaagggagagatgagaactaccttttttctgttttttttttgagacagggacttgctctgttgcccaggctggagtgcagagtgcagtggcacgatctcggctcactgcaacctccgcctcccaggatcaagcgatcctcctgcctcagcctccctagtagctgggactacaggcatgtgccaccatgcccagctaattttttgtatttttagtagagacagggcttcaccattttggccaggctggtctcgaactcctgacctcaggttatctgcccactttggcctcccaaagtgctgggattacaggcgtaagccactgcaactggccaagaactatctttgttttaatgtttcttatgtgccaggcactgggctaggccttgacttatgtccttcgatgtacaaaagggtagcacttactagcggggttgtatggttttgaagtacagtcatgcatcacttaatgatgagaatacgttctgagaattgtgttgttaggtgatttcattgttgtgcaaacatcctagagtgcatgtacacaaaccaaggtggtgtagcctactgcatacctaggctacgtgctatagcctattactcctaggccgcaaaccatgcagcaagtgactctactcaatcctgcaggcaattgtaacacagtgttatttgtgtacctaaacatagaaaaagtacagtaaaaatacagtattataatcttatgagaccaccatcatagatgtggtccatggttggctgaagtattatgcagtgcatgacagtggtcttctagttaagtgtaaaaggatgtacggccgggtgcggtggctcaggcctgtgatcgtagcacttcggggggccgaggcaggtggatcacctgaggtcaggagttcgagaccagcctggccaacatggcaaaaccccatgtctactaaaaatacaaaaaaattagccgggcatggtggcaggtacctataatcccagctacttgggaggctgaggcaggagaatctcttgaacccaggaagtggaggttgcagtgagccaagattgtgccacttcactccagcctgggtgaaagagcaaaactctgtctcaaaaaaaaaaaaaaaaaaaaaaaaagaggatgtaaatctcctgtgaaagaaaactttccatttcattagtcacctgcctccctcaaactcccatcacacatggaagctgctggtgcagtactgcatttatcagggcatatcttggatttgcttacatgatacttggttcagctactggattccgaatacctggtagaagacactgttcatccctgccctaactgtgttttcttagtttggacttagtttgtttatttggccttcattaatcacagggccaaactaacagccaaggttactcacacctcccctgtgatccagagcctgctctctcaaccacctccttatctgactctttcacagcaagccaatattttcccagccctgaatcaacccagggctaggtcccagacaactagggataactgtgtcccaaagccactggaattattccaactggccaatcctaggctctttcccttgtctctccttgcctttcctgtgaaaatcccagtaatggctgtggccaaggccttctcactcctttctgcctcctgatcagcactggtgcttaccccaggctttgcatggcctgaggtgcctcttgtttatagggcaactgtgagtaactttaatctttgctttcaatagcattggcctctcagatgtcacttagtcacctttataaattatgacccaggcacaaatcagtttttccgttgaccacagcctggcaccatacctttggacaggtagatgaaacatgtctgttgaatagaatttttgaatacctctgaagtggaaatggtcgcttcggctcacattgtggaaatccagagtggggaatcttcaccataggagtgggggccaaagcattagctgaggactggggctgaccaaaggagtgaggcaaaatgaccagaatggccaggcacagtggctcatacctgtaatcccaacattttgggaggatgaggcaggaggattgcttgagcccagaagttcaagaccagtctgggcaacatagcaagacccccatctctacagaaaatttacaaaaaaaaaaaaaaaaaaaaaattagccactgctaattttgaagcaggagaatggcctcaacctgggaggcagaggttgcagtgagctgagatcacaccactgcactccagcctgggcgacagagcgagactccgtctcaaataaacaacaacaacccccccccccaaaaaaaaacactgtattaattctttaatatataaaatccaccacaaccccatatttagatgtgcctgcaagcgtggtggcacgcacctgtagtcccagctcctcaagaggccaaggcaggaggatcgcttgagcccgggaagtcaaggttgcagtgaactgtgattgcaccaatgcactccagcctgggcaacagagggagaccctgtctgaagaaaaacaaaatggccagaaaacgttagaaaatatctaggctttcttgaattctttgtcaatttgttttaaatctgttgggagttttatgtttgctttttctgtgttctaacttaaacccagctaaccaccccagaactcattggttagcctcttatggacctgaatgacatgtatatcaagcagatggcatgctatttgtgtgttttgtttaatcccacaaaaatcaaaacttctacagcaaatcaatcaaatcgtgcaaataagagcgactacagaggataattagtggtttggaggaaggccacccataaacatgaaatataagtccgagaaaagaaaataaatcaaatgaaagtcagcttatcagccacagttgaaaaataactgtgaaaatccaaagccagtgtcttatctagctggaacaattggtcagtgtctctgaggccctggtaactgttgcaatgtttcctttctctgaccccctccctccctgaactgataatttagtgcatttttcccagtcagcgctgataagatccagcaggatgtcctgtgtcgtctgcacataccatccctcgaggctctatccttgcgtgggtacccacggcaacttccttgtaaaagaatgaattgagcaccattttcaagtcagcagggaactacgtgcactttttagttttcgcaaattagtgggtgtatgaattatttgtccgcatctttttacagtcttccatatagttctggatgcctggaatgtgtattagaacttttgttgaaaccaccaaatacctggaggttactgtaactaactggtcacagatgtagcattaaatccaccccaacttttttccctccagctacagcatatgccggagccacagttttatacatcttggaacaaacgctattcagaaacaaaaccaatacctttttaaaagcagtactaccttatttggggtcaggggctacctatttattttccaggggcctgtttatcagtaggcacatctaaatatggagttatggtggattttatatgttaaagtattaatacagtgtttttgttgttgttgttgttgtttgtttgtttgttttgagacggagtctcgctttatcgctcaggttgaagtgcagtggtgtgatcttggatcactgcaacctccccctcccgagttcaagcaattatcctgctcagcctcccaagtagctgggattacagacatgcgccaccacgtctggctaatttttgtgtttttagtagagatggggtttcaccatattggccaggctagtcttgaactcctggcctcaagtgatccatctgcctcggcctcccaaagtgctgggattacaggcataagccaccacgccccagcctaaagtattaataaaaatgtagaaaaacatttcctagttcttctaattctttgctgtgacctcacatgacaaattgtcctaatatcatcattattgttgtttttactttccctagctctccttcccagggaagtgtagtatcaaagaggcactagcatgtgggaaacctctggaaatggtgacagactgaggactgtgaggacaaaaatcttctaatgttggagccattgcaggatggtaaatctgatttcaagccacgtgatgtacaatgttaagggcttaataactgtgtttaagaaaatatatttaaaagttaaggccgggtgcagtggctcacggctgtaatcccagcactttgggaggccgaggcgggcagataagctaaggtcaggagttcacgaccagcctggacaacatggtgaaatcctgtctctactaaaaatacaaaaattagcccagctactctggaggctgaggcaggagaattgcttgaacctggggggcggaggttgcaaggagccaagatcgcaccactgaactccagcctgggagacagagtgaggctctgtctcaaaactaaataaataaaagttaaaagacaagtttttacatgcagatttgaaacactaactacatttatatgaacaaaataaaaaggaattctgacactaatacattattgctttgggaaaacaaaatatgctcctcttcctcataaaggcaagtgaacagaggttaatattataagctccactcactcgatactctgttcacctgagattataatattaacctcaggaaatcttgatggaacactttatggtatttcaatagttttaagtctaaatgcttttttaaaaaacctgaaaaggcacatgctatttgcaatactattctggaaggaaggaaagaaggaagggcagggcagggcagggaagggaagggaagaagggaggagggagggaaggagagagggaggggagagggatataaattagaggcatgtaaattagaagccatctgaagctaagaaatgaaagaaaaaaattagaggccatgaaactcctttagttcataattaactctctctgctcctcagtaatgtgtatttatgtaacatccccattttccagattacatgatttatcttatgttctatgctatattaggcactacatctcctctatctgaatataagtctatgccttcctgcagcatttgtatatccataaagatctcattcatcacaccagattgcaagttcttaatagcaagacatctgatgacaacggttactcacaaaataaactattaagactggaaatgtcatagtctgaatctatgaaattataaatcagtaaatttatggatcatttgaaaagaaaaagaagtagtggttggctattattggttaggaagctagaggtagggcccagaaatcttaaacaatttcttttttttttttgagacagagtctcactctgccgaccaggctggagtgcagtggtgcaatctaagctcactgcaaccttcgcctcctgggttcaagagattctcctgcctcagcctccgagtagatgtgattacaggtgcctgccaccacgcctagctagtttttgtatttttagtagagacaaggtttcactatgttggccaggctgatttcaaactcctgtgccacctcggtctcctgaagtgctgggattacaggtgtgaaccaccgcacccagccacaatttctttgattctaatgtgcaccaaagtttgagagccatggggcatgaccagtcctaacattcactttacagggacaggctctcttaggaacacctggtcactcgccctgtagatctcatgaactacaaagtgattgatggccccatttggggagctgaaggtattcacagtaaagtgcttcccaatttccctgtttatcaggaggtaacataacccagaagaggaagaagtacgtaggctttggggtcagacagatttgggttggatctcaatgctgccattcattgtgtgtcttcaggcaaatgacgtcatgtctctgagcctcagttccttctaaaatgtcatatgataatgatccacagtctggttatgagaattagatatttggtgaaaccatttagtacagagccaacattctatgagcattagctgttcttacgctgcacactccatgaagtttgtgtgagaatgaatgagagaaatgcaaagcacctcgaacatcatggcactctacaaacgggaggtggcttccatttctggggactaaatacaactaatgagctcatttgctgagaacatggaaggatactatttctatattcatttactttttgtgggaaaaatattacagagatggaaggtgattaagaaattttagaaagaccattccatttagcatttacaatggacaggatagcaagattgtccttccttccttccttccttccttccttccttgcttccttccttccttccttccttccttctttccttctttccttccttccttccctccctccctctctccctcccttccttcctgaatagtactgcaaatcgtatgtgccttttcaggttgaaacaaagcatttagacttcttaaaactattgaaacacacaaagtgtttagtcaagatttcctaaaaggcaggatatttagagctacttccattctgccagggaacccagatagcacaagactgcgagataacactttaatgagaagattcttatgtaatgggaaatgtgagcttaatctgagcatatggctgtgagtgtgcctgcgtgcatatgtacgtgtgtgtgacacctgtgtgtgaagagggcagtaaaagctggcttttacagtgtagaagagtagtcttggtgttggaaatcttggcaaaaatgctatggacaaaatatccctctgacagtaaattcggagtattctttgaggcatacaggatacatttacatctcctccattggatattgacacacattgtacctgtggctaagacattacttcacttcctttcaccacttcttccaagtttaattggaggatgccaagcaggcaactggccaagcagagaggaatgggaccatattataaactcactgaaagattcagtggtttcaagtactctctgtgtaccttgagccaaatcctcagccaacctggctatctgggcctggcttccatatgttcccaagctgataatatccccctcacagatcgggggtcatgagggttgctgctgatgtaccctgcacccacctaaacacacaatgacgacttccaggcagagacaacaggacctgcacctgtgcccacctccagctgccagcgatcccctcatgggaggagaattcagagattgagtgctttcagtgtggtagggctatagatgaaaggagaattcaaaaagggtctggaagacgtggttacactcctcagaggtgggtagtggtaaaggagaccatgaggcctgtgtttcctgtggcatggccaccatgccatatgcaactgctttctgatataggaaggaatacctcctttccatcccccatattatactactgttttgttttttttttaataagagacaagatctccctctctcacccaggctggactgccatggcaccatcttagctcactgcagcctcaacctcctgggctcaagcgatcctcttgcctcagcctccagagttgctaggactatgggcacatgctgccatgtgtggctaattttttaatttttgtataggcagggtctcactatgttgcccaggctgatcttcaaccctggtctcaagtgatcccctgtctcagcctcccaaagtgttgggattacaggcatgagccaccataccaggccagacttgtttttgaagggtttaattattttgtttaaattctgattgcacaatctagaaatatacatagaattctaggaaatgtcttattcttctatgaaggaaaaggccttggaatctgaatgaaacaggttggagttgtcctactctctgaagggaataaatgagctttaggaatggaggatccaatacaatcctagttcccctctgatattatgaggaagctgatcccatataagcttacatattgcttccaacatgcgtttagttgggttttttaggaacaacatgctcttctcattaaacccgtaggtctggtgacatttcatgtagctttagtccaactctgtggaatggcccaattgatttaatattcacattggtaccaatgatacaggataactgctatttaataaatggactaacagtcagctaaaaagctagtgtacccaaggtttcctcccactgttagatttcaatccaaagccctaccctttcttaacccaccctgggaagctacgcggaatacaaattcttgcataaaatgaagccagtgtcacatcagaaatgccaaacatcaaacaccagcagacgccaacctgtcagaatccatgctggcagattctggagcagcacactagaaaaatgtgatgtgagcaggaaggggaaaaatgcatttgaaatgagggcgggttgctcttgttttcctaatatccatgaaagggaggaagaattagggcaaaaagcaaaggagctcccatgcatttgggtctactccgtttgcttgacacggctgtatcctcactgtattatagcactatttccaagcattgtcatttgttctgaatcatctacaccaaaatgacaaatggtgttagcctgatgcttcctgaggcatatgtggttttacttccaatttgtaaatatggttcaaacagggacttttttttttttgagacagagtctcattctgtcaccccagctggagtgcaatggcatgatctgggctcactgcaacctccacctcctgggttcaagcgattctcctgcctcagcctcccgagtagctgggattacaggtgcctgctaccacacccggctaaatttttttgtatttttagtagaggcatggtttcatcatgttggccaggctggtctcaaactcctgacctcaggtgatccacctgcctcggcctcccaaagtgctgggattacaggtgtgagccaccgtgcccagccaacagggactttttgagcatttagtacccgtacagaaatctgacagttatttcagaacatcaaagtttttatctgatcaaaatagttacaatgtacaggtgtttgctgagtgtagaaaccacaggtgaaactgattttcattgtctttttttctcttattttatgtttctttgaactaggattatccctcaagattttcagtatcttaattccccaagactgtgggtcacactcagctagatatagaaacaagccttcccttttcagaaaggggcggtgtcccagggctgtttggctaccccttttataattgtgagtgaaattaggaaggattatctatgtgcagctagaacaatatataaggacacatgtgggtatatagcattgctatccattaaagtttaaaataaaactcagctgtgatgggaccagcagacagcctgttaccttcaacatcataggaatgaaagtcagcatgaaagcaaagccatcacgcttgtcaagggtagaaagaaacaaaagacatactctaagcttgtgcgaaccagctaggagggccgaatcgctcaggcccacgttttgctcattttaaaaggattctcggggagtggagaaggcacattccccagcagaactgacctgcccagaagggaaggcagaaaaatggacacatatttgattgaacttggaaaaacgtatgaagacattcggaattgcagagtatattaatgcctctgcaaggcagcctgggcgggccactgaaacctgcctcctagagccacagcatcagtgaaaccagcttcacagagtctgagtgtctagtcttcttgggcacaaggtaatatatttacaaatccctggccagaagatggtattgggaacagagatgcctaagctcttggcaaggaattgagcaaatagaatcaaatagaattggcctttctatccttttttgttgtttgttttttgagatggagtctcgtgctgttgcccaagctggagtgcagtggtacaatctcagctcactgcagcctctgcctcctgggttcaagtgattctcctgcctcagcctcccaagtagctgggactacaagcacctaccaccatgcctgacctttctgtacttttgtttaaccatttaaagtatacgtttcagtggcattaagtacattgatggtgttttacaaccatcatgactattcatttccagaaactttgtatcatcccaaacagaaactgtattcattaagcaataactccccattcccttcagcccctgataacctctactctgtcttccatttacaaatatacctcttctggatacctcagacaagtggtatcatataatatttctcattttatgtctggcttatttcacccagcgtgttttcaaggttcattcatgttgcaacacacagaatttcactccttcgtaaggctgaataatcttcaatggtacatatatgacatttatccatttatctattgatggacaagagttttctccacctttggccgttgtgaataatgctgctatgaacactggtgcataagtatctgtttgagtcactattttcagttctttgggctatatacctagaagtagaatggctggatcatatgccaattctacgtttaactttttgaggaactggcaaactgttttccataaggactgtaccatttcacattcccaccagcaatgaagggagggttccaatttctccatatccctgccaatatttgtggttgttttgttttttacacagccatcctaatgggtatgaagtggtatctcattgtagtttttatttgcattccatactttttctaatttagtcactaaagataggtatggcttttcctctgaaattccagtagtttctcttgttcaaccaaacaatgtgtgtatgaagcctatttcttcacagatttcagagctgctcagcagggatttcaccttgtcactgtcataccacacagcacagactgattggaattgaaggaaggcaaacagctgaatcaagaaaggcactttgcactctctctggggcaggatgaagggtttctttctttttctttcttcctttctttttttttaatacaacagcatcagagaactgccatttagtgcaaagcaggcaattcacccatcaagcctgtgaaggtagttgaagtagctgctctaatggctgaatggctggacaaaagcggccattgtggggctcactgcttttgaggacaacgatgattgctctgatctgatagcaagaccatgaaattatacctgtgatagaaagagctgcatcttgaacgagtcgctcctttaatgatcagctaatggcaacaggtcccctttacactactacacaaaaagtcacaggacaatcgtatgttcctttttagaagtagatgtatctgagctgcagcaggcatctctctgatgacagttacgaggatggtgaccctggttctgggactgatgctggcaacattcaggagagaaatgttgtggctggcgttctcaagtacacgccagtaaaagaaggtcatgtgccacactggtcttctttgtgtgcccttgaagctgggagcttcatttgtgggcatggagggaataacagtagtgaaggtaggtaggtaagtgtcccataaatctggctctaggctcgagtgctcagactttagtgagactattccagtcaacagcagggaaacccacctctgctggtaatgccagcctagaaatctggctgaacttgttagtaagtcaagaatagtaatcatcttgggaggccgaggcgggcagatcacgaggtcaggagatgagaccacggtgaaaccccgtccctactaaaaatacaaaaattagccgggcgtggtggccggcgcctgtagtcccagctactcgggaggctgaggcaagagaatggcgtgaatccgggaagcggagcttgcagtgagcccagaatgtgccactgcactctagcctgggcgatagagcaagactccatctcaaaaaaaaaaaaaaaaaaaaagaatagtaatcatcacaggggcttctggtgaactggcaacagagagcaaaaaggtagaagtgaaccttgaagtgatgcagatgttatttttcagatggactcttttgagttttaaggagaaaaacttccaaaagaaataatctgataggtctactcaatcaccattgcccctgtctaggcagagaatctttgtaaacctcttcctggttcctggtcatggattggctgcccttgggtcagctgattcaccaggctccaatcagctgagggggcttgctcacatgacacacaacgtggccactcctactgaaagactagagagcagtgggaaaaagaatttcttggggtcagagactgtgtatcacaactataattcatgggtctgatacattcatacccaactctgcacttacaaaaaccagacagttggacttcacatttttctcccttgcctaaaacttagaatggtttctgcagatcatgagaatatgttataaaaataatttaggtcaggcctcacttgcttttacaattgttcctaatcatcattattcatcatttacttaatttttcaaacaacccctcttcccacagaaagagcaagaatgataaagaatatctatataagtctcttggcagaaaaaaaactcctataagataatttccttactgagctacctgagttgagtagtttagatatttcctagaagaaggccagggagactcaattctcttcctgtccagtggttttgttgaatagtcagtgagtgaggaaaaaaaaaattaaaagttccttttcccttttggaattcttatcttagaagaactaccaagtttcaaagcaccacttgaatcttttttcttaaatatttagtgttgggttctcttactccctgttccctccttcccatcttcaaacagcaacacagagaactctcctctcagttcctgaggctcatgactttgagtcaacttctatcccacccttctctctctttccccaatagtgagtcattgctgagtcctgtatttgtatcctcttgacccatcctttccaatatattcctgcaattttggcaatagtcttatgtctggggctcttctgttggccttactctacagacttagatttcctacacagcctagagagcaatctgacataaatcccatttcgatcatgacatttctccattgacaaacctatgttcaagccactgtcaaattcagatgcctgtatcacatgcttcctacatttaagttcccaatctcatgattcattaactcacccccagtcattaggacagcccccaatctcaccactctgcaggccactgagtcaggccccctggcccatcagcctttctactggccatttccccctctggaatgatccccttattacccactcctgtgcccctgttcaactgaagtccgggagctatcccccagcattaaaccacgggcctgcacatcctgcatgctttccaagaactgccctcttatggtcaaacagcatcttcctgtccatgatgtctgctacccagatggcccccgaagcctctttcatgacttgttctcagtttagggatagaggaaaacagattctctcttctcaccaaagcaactctgttttagactcgcaccaggtgtacttataccaaaatcactaaagaacaatggaacatatcttttctctgccccaaatctccttactaccgaccacctggggtttcccagatgaaggcaaatgcctcctgaggttaagcttaaaaggcatctgtgttacctggaagggataagacattattgacacctagtgaatttgtaccatggattagtttaacagattggctggagcatgaaagataaaggagtagaacaaagctatattttgatatgttatatatcagtctggaatttctttggttacaaagggcagaaacccagtttgaactatcttggtcaatttatcttggaagacttaattgaatgacagaattggaggaagggttgaacaaacaagttgggtaagtgaaggcgtagagctgaatctgagcccaatgtttgttttttattttatttttgagatagtcttgctctgtcacccaggctggagtgcagtggcgtgatctatgctcactgcaatctccgcctccctggttcaagcgattctcatacctcagcctcctgagtagctgggtctacaggcacacgccaccatgcctggctaatttttgtatttttagtagagacggggtttcgccatgtttgccaggctggtctcgaactcttggccttaagtgatccactcacctcagcttcccaaagtgctgggattacaggtttgagccaccgcacctggcctcctgagcccaagatttgaatgctagcacgtaccagcagcagtaccgacatgccgctgcctagaaaagaaaactgtgtccctgagagctgcccctaaagggatcactcacgtctgctgcatagcagctcctgaaattagtagacacttgtttggaagctgtgtgtagtattataacctccagtatggcctataattctgttgcactaagaacctcttttagtgtttggagatatcaaatgtgtttatagctagagggtcagtgggtacattaaatttcctcatttgctgatatttaaactgagctacacttgtttaaatatatcgtttacgtctaagtgtaattgtgcttttacctttttctttgaaatgaattattatgaatatatatttatatctcacacataatggtgatgattaaaaccttaaaaagggccttggaacagatggtagttttagaacaaaacagatccattagctgtcaaatccagcttcccgtaggatgaaaaatagagttagttctcaggtagtactaagaaaagctctcacttaatctaataccttaggttatggattattttgtaaaaaatttgacatgggaaaactatgacaactcacaaactgcaaaaaataaaataaaaattcatattattctctaagcaaacaacacaaaacctaattgaaagtatattttaaaagatgatatgggccgggcgcagttgctcacacctataatcccagcactttgagaggccgaggtgggtggatcactagatcaagagatcaagaccatcctggccaacatggtgaaacccatctctactaaacataaaaaaattaggccaggtgtggtggctcatgcctgtaatcccagcactttgggaggctgaggcaggtggatcacctgaggtcagcagtttgagaccagcctgaccaacatggagaaaccccatctgtactaaaaacacaaaattggccgggtatggtggtgcgtgcctgtaatcccagctacttcggaagctgaggcaggagaattgcttgaacctgggatgtggaggttgcggtgagccaagatcacaccattgtactttagcctgggcaacaagagtgaaactctgtctcaaaaaaaaaaaaaaaaaaaaaaaaaacaaaaaattagctgggtgtggtggcatgcacctgtagtcccagctacttgggaggccaaggcaggagaatcacttgaacccaggaggcagaggttgcattgagccaagattgcaccactgcactccagcctggcaacagagcaagattccatctcaaaaagcaaacaaacagaaaaacagaaacaaaaaaaagatgatacaattgatttggaattaaatggtgcaaatttccagagttttccaaatacgcatagttttcctatccccatttgtgtaatctcttatttttttttaaccatgagaagaaggaaaaaataatctctaattttatagaagtagagatttctaggaccagagaaatcactagagatgacacaatgatttgtccaaggtcagacaactatttagagtcagagcagaagctggagtcaagtctcctcccctttatcctttctaccacctccatcaaatgctcagcagtccttttctaaaggaatggttctataaatagtcactcatgtcagattttctgtatgtgtatgttcatgtggatctactaagtaaaatgttttgataaaagatctttaaacaacatattgcatggccacaaacagttctcagggcaaacaaatatatttgcagatgttctgttctactcaatagagacaaaagagttctttgtataccacagaatacagggtctagagaccgctaaagttaagctaaaatgcctataagcaaatctgtgtttaaataatgcaattcatagttttacatggaaatgaaatgaaacttctgtccatcagcactagcgtaagtcaggcatgagtcagaaacataggtgtttaagccataagaaagaaaaggtggctgggcgcgatactcatgcttgtaatcccaaaagtttgagaggccaaggcaaaaagatcacttgagcccatgagttgcagatcagcctgggcaacatagtgagacgccatctttacaaaaacatacaaagagctgggcatagtggtacacacctctagtcccagctgaggaggttgaggtgggaggatagcttgagcccaggaattcgaggctgcagtgaagtatgatcttggtgctgcactccagcctgggtgacagagtgaatgaaaaaaagaaagaaagagagagagagagaaagggagaaatagaaagaaaaagaaagaaagaaagaaagagtgagagaaagaaagggagaaagagaaagaaaaagaaagagaaagaaaaaggaagagaaaagaaaaaagaaaaggaaagaaggaggaaggaggaaggaagagggagggagggagagaaggaaagaaagggaaggaaggaagaaaggaagaaaggaaaatatgcaaataggcaaagcaattttatagaatctgaaaacttcactattattcaagaagtgagaaagataaatttgacttgatataaaatatagtgtgatgattaattttatgtgtcagcttactaaatcaaggggtggcccaggtatttggtcaaaccttctgtgcgtttctgtgaggctgttttttgaatgagctgaacatttaaattggtagacttgagtacagcaaatcaccctccctaaagtgggtaggggcctcagtcaatcagttgaaggactcaatagaacaaaaagactgaccttgtcctaagtaagggagaattcctcttgcctgactgcctttgaactgggaagctggcttttttccaccttcagactcaaagtgaaacactggctcttccaggtctcaaccctgctggccatcagattggaatgtgtaccatcagctctcctgggtcttaggattctcaactcacgctgaagatcttgcaacttgtcagcctccataatggcatgagccaatttcttataatcaaatctgtatctatctatctatctatctatctatctatctatctatctatctatctgtgtatctatccatccatccatccatccatctatctatccatctacccacacacatcctgttggttctgcttctctgtaacacactgatgaatacggatagcaattatttgcactctggaaataatcgtagtcactcgatctaagttcatcttgtttatatagtcacagttttcaaactgatttgccatcacattaataaaataaagaaacaatcctgatatgagagcagtaggtatcctgatattcatcagtttcttttcttccagttatataacctttcttgttttaatcttttggtttctttatgaactcaggtttggtgttgtatttttccctatttcaaaggagtaacctgattgtcttttggtgtgatttatacaactggtatcagcaagcttcaaattgggacatcaggggaaaagcaggcttacgtaaaatgattttgtgaccttgaattggtctttacatttatctagtatttctacatttatcttttattcatcctatggtaagttcgttcttaccatgagattccttctagctcaaaaattctgtaataaataaaagacatggtttctgcttccaataaatttgtcattgagctagagagaagatatgctggattgtaatacaggcaaaggttttgcagtggctttgagaagacagagattaaggaagcagtgtgatcatgaaaagctctttgacaaggatgagatgcccttacgtgatgggatgaaggaagagcttcccagagaggggcaatgtgagttaagagccaaaaaagcgagaattggtttcaagaccaacgacatatgttgggaatcatgtgtaggggtgggcagtggagatggggagtgataggttgagcctaaaaaagtggccctccagccactttgcaactgagcagagtcctgatttctagcatccgtcatgacttagttacctattctatttaatagtgcccatgggtttaaggtaatgtccaatccatgaactacatgatgtcctacacatctgcatagcaggaatgtatgacatccccgagtgtttgtttagccaatttcaaacaccaatccagtccttccccagaaagtctatttgtttaatgaactcttttgaaatgttaaaattcaaaattacgtgacaaattgggtgagttgcaggcaaaatgtataaaactctgtatatgtctgttaactcattggaaaatgggaaatttagacttttgtcagcattaaactatcaccaaaaattaaaattaattttaatttttaaaattaaatttaaaacaattacattaaaaaattatttttttaaagacaggattttcctaaaaaaaggaacatgtacaaagtacactattgattaactatcttaaaaaaaatctagaagcaaagtctacttattgtctgcctcttttgtgcattgaacttttcccctccacacccttagtggacaaatttgtgtaaccagcatgtcagagatgtagggcattatcccaaagggagcattcactgacagggcagaagatagaagctactactgagttttaaatgagctgcattagacaatccagttgagagcttacttcttttggtttgcagctgcctacaggatgatgtcagttgacagaaggtggaaagttccgtgtttgaatgcatcagtttcttcagctttgcatcttcagcagtgaattcagcaggctgaaaaccatgtcacaaatcctgatcattaattgccacccaccctgggtggaaatccaatcctactaatgaaaaaagttgttcaatgctttgttccaacaaacaaaagtcatccctgcttttttaactgcaatacttcccagagcacatatgctggatgaagcaatggtggggctgtccaccaagccttttcaaactgtagattcaaactctttccaatctgatgcatgtgatttgaaaatgctcctataccttttataaataaagaagttagatcagactgagaagtcagagatagttttctaaaagggttacagttatttttctcttttttaaaagtgaagagcagatttcttagtgttggtagatttttatttattgctaaagagctcctgctgtcacctgttacagtgggataaatatagtaaaccgaaccctagactcagggtccagagacttggggtgaggggagtcttggcccttcccaattaagcacgtagtgtggtaggggaacccttattcctgctagtgagatagagtcttgctccagactcctctccacttttttataaactctaccccaggcaaagaggctaagtggcaaccgattgtcaagtctgggaggaggccaggcacggtagctcacgcctgtaatcccaggactttgggaggccgaggcgggcggatcacctaaggtcagctcaagactagcctggccaacatggtgaaactctgtctctacaaaaatacaaaaattagctgggcatggtggtgggtgcctgtaatcccacctactcaggaggctgagaagggaaaatcgcttgaacctgggaggtggaggttacagtgagccgagatcatgccattgcactccggcctgggtgacggagagagactccgtctcaaaaataaaaataaaagtaaaaataaaaaataaaaaagtctgggagaaggagctgaacacagtctagcactttactcctccatctcttagaatgtaccagttagtgcacactcttggccagttctcaaggagggtggcctgtagttgtttagcagtaacactgtccatggcagggaaagtatatctcatttagggacatggtattaacaagcccacttggccagtagactgaagcatcattctccagaaaaaattctccattttttcagtaatacaattgcccaactcaactgattttgaatgtgggaagagaaaaagcagggcggggaagtgggtattactttttcattcctattggaaaaggtctagcatggtatctgaaaccttattggacttctgtaacctttgtttgtttgtttgtttgccagagtctcactctgtcgccaggctggcgtgcagtggcatgatctcagctcactgtaacctctgcctcccgggttgaagccattctcctgcctcagcctccagagtagctgggactacaggcatgcaccaccacacccagctaatctttgtatttttagtagagacagggtttcactgtgttggctagaatggtcttgatctcttgacctcatgatccacctgccttggcctcccaaagtgctgggattacaggcgtgagccaccatgcccagctgacttctataaatttttacctaaaattagtgaaggtggagagtgggtctggtgaaaaagcaaagtaggctgagtgtgaaaattagaaataggaagtcagtctgactgttgatccagcttcgaactcccaaagataggtcattagcattagaatggaaaacagggcaatcattttccccatgggaagttggagctaaaacagtcaccctaggagttccagaacacacccctgttcccagagcctgatggtctcagccaaagctgtaggagttctcactgcaggcctcctgattcttttgtttacttagagcaagcagagagatcggtcagcttagtgttcaggttttaaatcaagtagtttgggagatagcaagataaaggccctgattcaatttcagtttctttctcttttaaaaataataagattccgaaatacaataacccaaaggcaggaactggataaagtccatgggaagaaaagaaaacaacggacagataatttatctctatcccaaggagagaggcagagtccaaaaataatgctcattggctgggcacggtggctcacacctgtaattccagcactttgggtgactgaagggtgtggatcacctgaggtcaggagttcaagaccagcctggccaacattgtgaaaccccatctctactaaaaaaatacaaaaattagccaggggtggtggtggcgcatgtctgtaatcccagctacttgggaggctgaggcaggagaatctcttgaacccaggagttggaggttgcagtgaggtgagccaagatagcagcactgcagtccagcctgggcgacagagcgagatgccatctcaaaaaataaataaataatgcacattaaccaaaatggagctttattttccctctttagtgcaaattttagaaaccattgatgacagaagggcttacagatcctaaatccctcttaggttctatggtggcaataaatcattgtaagtatgatggattgagcactgtgctgggggtggaggctgtaccatgtccttggtaaattcaatttcccactatgcatcaagatttcgtcctctgcaaaatgaagaagctgagagctttcttccctaggtggtgagggtgggcttctggctccagttccttctacctggcgagtgcaacgtggcaccacagtggtgtcagcgaatggctactggagagaaggcagaggctcggagaagagcatctgtcttccagcaattgaataacacctcttctcgccctgctcagtctggctgccccatttggcagtcacttgcaaactactgctgtgtttccgtctgtcaaatcccagcagaacatcagggatagagagtgtgaaatgtggatgcttcttccgtgtgtgtgtgtgtgtgtgtgtgtgtgtgtgtgtgtgtttgctactaatggctgtcagggatggaaatgttggaagaccttttcaaaagtcccttctgaaatacataaaaatatctagagttcattagataattgcttcatagaatacagggttaccatcaccattcttgcagccagtgacagtgtctgatttattcaaaggggtaagaagtcattgcagatgagttaatcacttggaatagagcagcagatgccagatgtctaatgaacagcaaggcttttctgtattttaaggtttttaaagtacacacacacacacatacacatcagctctgctgtacaaaagtgattcacaatacatgaaatcatgattgtttcaaaataaattcaaaatgactgatttgttttgttcccaattacattggtgaaaatggtcaaaaagaatgtgtgtgtccatacattccctggttaacttcaccaacagctagagaatatgtggtcattttccttctcaacctgatgggtgcttatgtagtcaagtgccatcatctttagtttagaggttattacccaaacagctgctgggctcagcaatatgataaatggtgttctttatattcctgtgtttctgaagctaatgacacaaaaaataccctaagaggacatcaagctcccaaacgatcatgagcactatttggttacttgcagattgcttccagaatttttgagaagaaaatatttgcacaggccagttgcggaggctcacgcctgtaatcccaacactttgggaggctgaggcgggtggatcacttgaggtcaggagtttgaggccagcctgaccaacatggtgaaaccctgtctctactaaaaatgcaaaaattagccaggcgtggtggcgggtgcctgtgatcccagctacttggaaggctgaggcaggagaatcacttcaacccagagccagaggttgcaatgagccgagattttgccactgcactccagccttagtgacagagtgagactctgtctcaggaaaggaaaggaaaggagaggagaggggaggggaggggaggggaggggaaagggaaaaatgtgaacattcgacttcttattcttgtctactcctaaatcccttcccatattcagtcaaaagtcctatcagaccatgacgcgcaggaccctaaaaactgaaaaccaaatcactgtagggaacgtggtgcctccaggcctctgggacacagctgtcctcccaaggtggaaggattggtcgcttccagctcattgtctgtccgttagcttctgctctaattcacatgctattgataaataagatggggggcaagggagggaaccggagccaaaccccacggcaggattagaaatgccagccggatgcaggcaaagccttggaaaacaacagggttcatggctgggcctcccaagccagcctgggccaagctcattaatcttccaggcccactgacttactcagaccacaggtgcacacgctggtcgtcatcttcatggccaaataaaatcatcaaaactctggaggagtaacaacatggtaacttaaagacaaccgactggtacgtttatgagaggctttgcaatatgatttctgacagttgtttggcatcattaagagatcactaaacagagctaagaaaaaattttttgaaaatagatgtgattctggacgagattctaataacataatggaatctcttcctaaatttgtctttaaaggaagctcttgtcaaaaacaaggctgagaggataaagataggttataacaacacatgcaaactggcgtcagatttttcttggaggggcgtaggaggtaggaaggtgggaagatgtgaaaacataactttatcaacgacttgaatttcctcataatagcaataactattctttgttttttatttttagtttttaacaaagtcttactatgttggccagactggtcttgaactcctgggcttaagcaatcctcccaccttaacctcaataactatattttaaataattttatgattaaagtccttggctatttagggctacatatgtaattatctatggacataataatttgatgctagagaattgttttaaataagacaggcaaaatactaaaaacagttgaaattcttcatttacatggtttgtaatttttttctactttggactaagtttttaaattttttttttttttttttttttttttaggccaggtgcggtggctcactcctgtaatcctagcactttgggaggccaaggcgggtggatcacctgatgtcaggagttcaagagcagcctggccaaaatggcaaaaccctgtctctactaaataaaaatacaaaaattagctgggcctggtggcacgcgcctgtaatcccagctacctgggaggctgaggcaagagaatctcttaaatccaggaggcagaggttgcagtgagccaagatcatgccattgcactccagcctgggcaacagagcgagactccatcccccaccacaaaaaaaaaaaaaaaaaaaaaaaaaaaaaaatatatatatatatatatatatataaagttactttatatatatatatatatatatatatataaaaaacattttaactctttgcaagaagttctttaaagtttatctactttaggtctaaaaacaaagagtagattttctacgacactagggatcctctggaaggagaaaggagaatggccgagaaagcagaggaaggggaggagtttgtccagtgagtcgctgtgcaccgggacccagggaaggtgataagtggcaggaaggactgaggacaaatattctcatgttggtgtgtaactccagctcctcctggcttatgctggtagacaaagcaaagtagctgggaaattctatagttgtcaaaaccatcacaaccactcccactctcccatctagttcccaagccctccgaacagaagctagcaggccaatgcgttgtttttagtttaccaaacctgggaaacagcgggcaagagagaatctcaccacggagcacaagcccagcgttttatgtcaggcagcccacacgatgagtcgcttagagtcttccacaaagaagctttctccttcctgtgggcaggatgaataacagcacccagccagcacgttggatgcttggcattgggagctttaacgttcccagctttgactatctttgaacaaccccccaaacctgtgacatgtaataatttgtacttccaccggagcatggactagaatggtacaagagcaatgtttgagggtgagagtgaatcatttagctagtgaaggaacctcgcttactgcttagcatctccaactcaggattcactgtttttctgcttggtacctctggaggggtgttatggaaaaatagaatattctgtggcagtaaaagatccctaaataaattatgcttattctgaaagtgaaaagacggcagaatgctctaagtaggccatgggttttagccagaaaatagagctttgggataaattttaaaataatggatttaccacaataaacaattggaaaaaaagaatagaatagactatggaaggaattcaaaatttgcagatacactaaggttctagatattgagtctaccaatgtgttttctaactttgagatgggaaagagctgtgttcttgaggtagatactgagaccatgccagggaaggaatctacctttagccataagcaagggaattgattcacactgggtgtggtttaaatgttgataaaacccgcaatctcctggtttttccatggaaatcccaatggcatactcattctatgataacttttggtgtccacatattcgtgttgcttacaagatagtgttcacatctgggcacccacatcagtttggataatttgaaactggcatttcagtgcacataagctgcctgtggagaggtacgagacagacataagactcacagctggccccctgcaggactgcagaacaaactgagaaagaggcttgctggctcgctgcattaatgatgagtctcttataggattgcttggtgccttctgttcctgagatcctgccaaatatgtcctgagctctagccccccgcatgtggctcttttttattatcagagccacactctgatcctcaggacttaactctggttggcaccactaaagccacgggaatcccggggatagagtctagctcagagattcagcaagtatttgcagatccaagtccttttgcaagagagtcacgggaatcccggggatagagtctagctcagagattcagtaagtatttgcagatccaagtccttttgcaagagtctccaaattaaacgccaaacttcttgcttgtatagaatattggatgactgactattgcccacactaattgggtcctctcctgaaagcttgcatatcttgttctaaagaggttggggccttcatgggattctgtctttgttacataacactttgctcggctcatgaggacttaactatgagatggttgatgccgcaggaaggaaaagagtgtgattctctttgggggttgataaagggaaatcattaggaacttgcctccctgcattgtcattgctttgttaagtcaagatgaaagttcatcaacagcagactgggcacagtggttcatgcctataattccagcactttgggaggccaagacaggcagatcacttgaggtcaggagttcgagaccaacctggccaaaatggtaaaaccctgtctctactaaaaaaaaaaaaatacaaaaattagccaggcatagtggtgggtgcctgtagttccagctactcggaggctgaggcaggaaaatcccacgatcccgggaggcgggaggttgtggtgagccaagatcatgccattgcactccagcctgggtgacagagacagactccatctcaaaacaaaaacaaaaaccacaacaaaaacaaaacaacaaaaaactgcttacagagggctgttatgaaatatgggagatacaaaggaacaaagcctcccaggtgccgtggggctgctgccacagtgcatgcaatattcatcttttgttgaaagcagacgagtgctacttctacctgcattttcccttatgcagtctggaggagactgcatggcagccttatggaaagaaatcagttctcttcctgctcccaactaagacaccatctttgcctttggaaaaaccagccgcccactcctaacttagcttcttccccacacacctcaccgatttagcccacctgttcccagtcattttcattctcccacctcctcccgaatatctgtctccctgatctcgctgagatgtggagtcatttcccttcttttcctcctcctacactctctctgaaacaagcacaccaagtcccccatttgggagtgcaaaggaggacatctagttctcaccagaaattagttttattaattgtctgagtaggttgttggacccagtgattcagatttcagcccggggtggatcttggccggtgcacctccagctagggtgtagttctgagtccctttggtcacctcatccttttccttagcatccctctggcccttggacgaactttatgtttattctctgtgccctagaactctgggtccttccctggttcatgcctctatttttctttcctgcatagaacttgcagttcccaattttgcccatgatggacaagttcatggctctcgtctcttaacgttattttctgaaccctgacccatttcttcacttctctttcagttttgttgatagatatttactgatcattaaaattgattctacccctgggggaatgagtcatggctttttaacctattgttctaaattaattcctgggccagccttgcaatggccctgtggcctcaacaatgggcaccagtgtcccaggtgccttggaggtattttctcagctccacccaacaacctacagcccacttttcatcttatcccattgctgagcttgcctccccgttcgacctgctctgactttgaatttggggctggaattgtgcattttgttcttttctcatttgcacttcatgtatctgagtattggaacatttatcctgctatgttttaattatttgctcacctgtggaactcccagtcctgatcacaagctcctcatggtcaagggctgtgtctcgctcatcttagaatcgtgagtgcctggctcatgagagatgctcaggagatattgatgaggttagcagctgagttccccagaggggaagccttagagccttctataagcccagccttgccatagacagtacttcactcctggagcagtggtaatataaaaaatgaccacattagtaagtgacaggctgttcctattcatcccagagactttttgcaggggttctttgtgtgtttctatttgctcatttgtttttcagtaaggcggaacttctctttgaagcttgtggcatgttaagtccactgaccacaagctagggaaaaaatgcagtattttgctttttttgttttattgtcagtaaaagtcaaggttcagtccacaggatccacacagccatcagaggggccagtgtgtggagaagctgccaggaaagatgccatcagcctgggccattgaggtcttctctgtaaccctgcctctctgtcttcctgactcacctgccccaccgccccaggtgctggggacagaggcatgtgtattgcagaccaacactgatgatgggcggccccaccaaatcagcctggagctcaactcctgctgcaccaccaaccccactgccctgagcctcagtttcctcgtctgtaagatgtggaaaatgctacctaccttgcagagttgctacagggatcagtggtaatgcaaaaatgctattactattgttattattatggaaatctctaggcaggaatcacattctcaagctggcacataatgaaaatcaaggaatcactaatgcattattcatcacaccttgacatgacttttatataacattcagctgaagtatcttcgatctgtatcttcttatttgctattctgagttcagaacataggataactagctcatcagttcaatgagctgggattttttttttttttttaatgagcatctgtttgtgccaacatctcaggtccctgaatgtaccccttctcctgaggttgaagtataaattgatgaaggctcaggtggcgtcatggaatgtctcaaatagattaaggctgcacgacacgtgtgtgacttgtattctatttggagacagtgtgggaaggtgaatccagcaagagctcaaattttccagtgagcaaatgtagaattttaattagcttcgagtccatttctctgctggaaatagatctctgagcatttcttcaatagcattacagtaattataacaattctgaaaggaataagttacaggatgtatttttgtaagcttagcagaataagaaaggccacatccagttctgtatttggagcatgcctggagttgctgtcaaatgatgctcaacagcatcaatgacaataatgtagaccatcctatccacagtactctaagactgtactgcccatggcacttcctacagcaatagaaatgctcaaaccaaatctgcactgtctaatatggtgggcactggccacgtgcagctagcataactaagggctgaattttaactttatttaattttaaataattaaaattaaatagccacatgtggctagtggccaccgtattgagcagcacagataccagctggtgcttactctaagccccctgcagcctggggtattagtgggacaaaggaggaaatgtcaaaggcccccaaggcaccataaagcccacactctaaagctcaaaggaagccaattcattgagttttctatttttcatcctacagcatatcagatgcatccaattagaaaagagacgcagggcctggtgcagtggctcatgcctataatcccagcactttgagaggttgaggtaggcagatacctgagtcaggagttcaagactagcctgaccaacatggtgaaaccctgcatctactaaaaatacaaaattagccaggcgtagtggtgcactgtagtgggcctgtagtcccagctactcgagagactaagacaggagaattgcttgaacccaggaggcggaagtcgcaggtttgcagtgagccgagattgccccactgcactccagcctgggcgacagatggaaactccgtctcaaaaaataaataaataaataaaggaaagaaaagagacacgggtacaatggcagcaccctccagaaatgaaaaagtttgaaaaggaaacaagactcaaaggagaaaaacagcctgggattcctgagcccaaggataagcagcctttatacctcaaagtcatcaaggaaacgtcaagagttcaaccacagaggctccaggaagggatagagggaaaatgagcaaccctaatccagacttctggccatcaaaggtggtaaaatatggacggtattgctgccaaatgggtgagttttggttatctggagagtccagctgctggtcacgtctcagtccctccctaatagcaccttgtgatgtccttttgttcttgggagaaataactcctgcgaccctcgggtctgcctaaagtagctttgcccacagctcctgcctcagtttatatgacttctcctgactctttgttctctagctaggctgatcgtccttctgcttcctgaaggtgccgtgatccttcctccacaggacttctatctagaaggtttcttccatgctacccctgtttctcccccagctggctcctaggcaccctcagatctcagctcaagtgtgttccttggaaggccccctgaatccccaacccatccccaccacatctaggcctggtttctttgttagtcactcttcgccctgcatttcttcccagcaaatacctacttgaatatactcgtgcatcagtgagatgaactgatttattcatctgtaaactccaagaaagctgggatggtgtttggcctgattcatttgcttttgtgtcctcagttcctggattgtgctcaataaatgcaaaatgaaagaatgaatgaactccagtttatttctaagattttcgacatgacaagtgtcctccaatccctaacactttcacatcttcctaaaaaatctctttaagctttaggatgactcatattctctttgagtgccattccaaagttcttactgtccaataacttattatcatgaaatcttcaaccttaaaattccacccacttctcctttgtttgctccacttactacatcgtcccccaaaaacttcctgattttttttaaacctttggagctcatgttgcaagctgaatcacatctgtggttcttttcttggcaatgtactcgccttggttttttcagtttccttcacttggtttatctgatagcctctgagctccttatttacttgctaccaattacttaggtgtctattacttagatagctgcattatcttttgaaattcgtagtttatccttcacccaggatttttctattattttttccatagactttctctaaactgtgaatctatttcttattctcttttaaagaaaattatttaaaagtggggaaaatgaaacgtaaacataatcccaactcatcttacacctcatctttgaaacataagacatcattgcaaaagaaagatctcagttaattatttccaaagccttcaggggatttattcctaacttctcattttctgtctcattcctaaagaatcaggggtaaaactcccattagtcctaattaccctccctaaatccaatcaagtcattatgcctcagactttgttttctttagaatgagtttcttatctagttaaataattttctctttctaatagactttatttagtaccaatttcttgatataaataactctcctctttagtaagtgtttgtgaagcacttattatgttccaggcactgtgctagggaaacagcatgaataataagatgaaaaaaaaatccctgtcctcatggagattatatttaacaggaaggggtataataaacatatgaatatatataatataattttaaataatgacaggatctacaaataatctttatgccaaatgccatatacaatgaaaaaatctgaatttatactaaaacagatgttagatatgagttctaaatttcttttcaaagaatcaatatgtcagtatatgttcaattctttgtcttctacttgtaaacttaacttcctcgtaaagtaacctttttcgattacctcctccaccctgactcatttcaatcacttgctccaccctgactcattgcgattaccggctccactctaactcattccgattacctgctacctgctctgccctgactcattctccatcctgcataaccatttctcccaccaaaccactcacccagtcactctctttaaattagccaatcggaattagtttagcctgtgcggtctaaccctggccaacaggggaaggacacagcagcaggggccatgtgtgtcagggataagaaccccttcccctcccttgtccaagtgtgctgctcaccattgctccatctgtaaaggcgcacccttctatagaagtagcttgccttgctgagaattaaaaataaaattttacattcaagtgctatttcttttacggcactgaaactttatttataacatagagaagggttgatattcttggtggaaattatgactctgttttgttaacaaagagtcgaactctaaaatatttgaagagatttatttattctgaattattctttttgttgttcttgttttgtttgagggtttttgttgtagttgttgttgtttgagacagatctcactctgtcgcccaggctggagtgcagtgacgcgatctcggttcactgcaacctccgcctcctgggttcaagcaattctcctgcctcagcctcccaagtagctggtattacaggcacccaccaccacacccagctaattttttggtatttgtagtaccgatggggtttcaccaagttggccacgctggtctcgaactccgaacctcaggtgatctgcccacctcggcctcccaaagtgctgggattacaggtgtgagccacccgaccctggcctattctactttattcttaaacaaagcctgaggcataatgacttgattggatttagagagggtaattaggactaatatgagtgaccaatggcccctgacacagccctcaggagatcctgagaacatgtgcccaaggtagtcagggtgcagcttggttttatacatattagggagacatgagacatcagtcaatacttgtaagatgttcattggttcagccagagaagtgggataactggaagtgggacttccaagtcaggcagattcaaagattttctaactggcaattggttgaaagagttattatcaataaaaaggaatgtctgggttaagataacgagttatggagatcaaggttttatcatgcagaggaagccttcaggtagcaagcttcagagagaatagattataaatgtttcttatcagatttaaagagtctgttctggttgggtgcgatggctcatgcctgtaatccagcactttgggaggccaaggcaggtggatcacaaggtcaggagtttgagaccagcctggccaatatggcaaaaccctgtctctactaaaaatacaaaaaatatagctgggcgtggtggcccattcctgtaatcccagctactcgggaggctgaagcaggagaatttcttgaaactgggaggtggaggttgcagtgagctgggatcacaccactgcactccagcctgggtgacagagcgagactcagtctcaaaaaaagagtctgttttattagtaattccaaaagggaggagggtgtcatgaggcatgtctgaccctcctttcctatcatggcatgaaactagtttttcaggctaacttatttatttattttattattattaattttttgttagagacagggtctcactatgttggccaggctggtcttgaactcatgacctcaagtgatccacctgccttggcctcccaaagtgctgggattacaggcctgagccaccacgcccggctcaggctaactttagaatgcctgtggctgagaggaggggtccattcaggtggttggggggcttggaattttatttttggttcatagtcttttaagcataaaatcctgtcataaacatcttaagaaatcttatcttcactttgctgtgtttcagtgaaaggggagattatccactcattcacttagagacatttgcatggtgtctactgtgggcaaggttctaacatacatgtacagtgttgcaatgaagaacaggaaagcttcaaccttctgacctcaggggtgggactgaagtaatgagcagatgccagtgtggtctttgcctgggaaatgtcagtgagggccagagggtaagctagtactctacccttcagaccactccacaactcatctcccacctagtcaattttctgtggctctagacgacagaatcctggttatgatttttattattattttattgtggtaagaacactttacgtaagatcttaacataccttcttaatgttttttctttttttgagacaaactcttgctctgtcgcccaggctggagtgcagtggtatgatcttggcttactgcaacctccacctcctgggttcaagcaattctcctgcctcagcctcccaattagctgggatcacagtgggtgcttaccaccatgtccggctaatttttgtatttttagtagagagagggttcaccatgctggccggcctggtctcaaactcctgacctcagatgattcatctgcctcagcctcccaaagtgctgggattacaggcgtgagccactgcacccagtctaccctcttacatttttaagtgcacattacaatattaacttataggcataatgttgcacagcagatctctagaacttactcatcttgcaaaactgaacatttatacctgttaaacaacaccttccgctttctaccccaaaccctgccaaccaccatgctactctctgcttctatgagtttgactattttagattccttatataagcagaatcatacagtatttgcccttcggtgcctggcttattgtattagtttgttctcacactgctaataaacacatacccaagactggataatttataaaggaaagagatttaatggactcacagttccacatggctggggaggcctcataatcgtggcagaaggcaaatgaagagcaaagtcacgtcttacatggcagcaggcaagagggcatgtgcaggggaactcccctttatgaaaccatcagacctcatgagacttattcactatcttgacagcagcatggaaaagacccacccccatgattcaattacctcttaccaggtccctcccatgacacatgggaactatgggacctacaattgaagatgaggtttgggtggggacacagccaaaccatatgactgatttctcttagcataacatcctcccagttcatattgttgcatatggcaagattttcgccttttttaatgctgggtaatattccactgtgtgcatagaccacattttccttgcccattcatctcctgagggacatttaggttgtttctgtatcttagctattgtgaatagtgcttcagtgaacatgggagtaaagctatcacttcaagatcttgacttcaattctttgagatatatacccaaaaataggactaccaaaaaacagtacggttgttcctcaaaaattaaaagtagaattatcatatgatccggcaatcctggttgttcttttgccataatatttaaagatgtatgtaaggagataaaggcaaataattcagattcatacacttaagagttggaaggaacttcaaacgttgtatgtcaaatgttaaaataaatgttaaatgttaaaattgatgttaaaatagataagaaaatacctgttcaaatattaaagtaaatgaggaaatgcctgtatatttatgtataaatacacacacacacacacacccacacacactcacagccagttcttttgatcccaaataagccctttctctattgctactataataacctactgataataaacagttagtgagtcaatttttctttttttttttttttttggacagagttttgtgttgttgcccaagctggagtgcaatgacgcaatcttggctcactgcaacctccgcctcctgggttcaagcgattctcctacctcagcctcccgagtagctgggattacaggcatgcaccatcacgcttggctaattttttgtattattttaattttgccatataacacaggaaatgcagttcaatgggagagtggtaagtgctatggcaaaggcacaaagaaagtatcatggggatacaccaaaagaattgaactctagtttgaatagttctggttggaactagcctgaaggcagagagggaggaaaaagttcctagaaagaggaaactgagaagttaacttacagaggcctgggggcatgtggctcattcaggaaaaggaaaatgatttcagaggtcgtggagcgtaagtcctgagagggttgcaggtgggagggagagtgaagcaatttcacaaggggctttacatgctgtgttaagggagtttggatttgattcagtagcaggtttttgagcagaagagtaactttattagagctgtggtttatacatggaatcaacctaggtgcccatcaacagtggattgataaagaaaatgtggtacatatacaccatggaacactatgcagccataagaaagaatgaaatcacatcctttgcaaccacatggatgcagcggaaggtcattgtcctaaacaaactaatgcaagaacagaaaaccaaatatgttttcacttataagtgggagctaaacattgagtgctcgtggacataaacataggaacaatagacacactggggaccactagagcgtccagggaggagggcaagggttgaacagctacctgttgggtactatgctcactacttgggtgatgggaccatccacaccccaaacctcagcatcccacaatacacccatgtaacaaacctgtgcatatgtagcccctgaatctaaaataaaaaaagttgaaattatttgaaaattaaaaacatatgcttgtcaaaagttttttgtttttgtttgtttgtttgtttgtttgttttttaaatgaactgtgttttacaattaaacttagagaagagagaagagcggagggttgggggttggctgaaaaatggtagctcaattctgttattcacatgttacctgtgataataatagttagcattgattgaatgtgctaagagctttgcatacattagctcacttaattgtcacaacattcctgcaggctaggagcttttattatttttactttacagatcaggaaatgagtttgaaagcttgagttacttgctagaaagaggcaggttgtaggaacatctaggtcacttttattcctaaatgcaccctcttcactgagctgctgtcctgccctgtattactaaatccagttggcaatgatttctttgagacaggtatgcatgagagaggtgaaaataatttttcaacatccctataatggcagatatctaaaaagatgaaaagaagacaaaggcagagattgactgtgctgtcaccagccttgcaactgtgacattcaatccctaaggggctcctttctctctgtctgttttcttttctttctttcttttttttttttttgagatggagtattgctctcttgctcactgcaacctctgcttcctgggttcaagtgatcctcctgcctcagcctcccgagtagctgggattacagacacgtgccaccacacccagctaatttttgtatttttagtagagacacggtttcaccatgttggccagcctggtctcgaactcctgacctcagatgattcatctgcctcggcctcccaaagtgctggaattacaggtgtgaaccacaaacccaaccctttctgcctattttctagtccaaatcctcagtttttgtttgcatgtactgaaataatgcaacataattttcatattagtttcagaaaattaagaatcagaaaaataaggctattgtaaaataattcacataatgcttgtcaaagcctactgccaatgtgttattttttatcatctgctatgataaattagcattgacattaattgacacgactgcttttgataagtgtaaaacatcaaaagctgattttacaatttatgtgtaaagatctaaaatggtgattttgcatcctatattctgaattggttaagacccagcattaatgtaactctgctaactcttccaagcatttatttcctagtgatcacgtctaggaaggaacacagcactcccttcaggataaaatatcttcaagtactaagaccccaaccaatatttgttccttcacaattccagagccatagaaccacggttatagattatgctttagacatcatttattattttaaagagatgcaggctgggggcattggctcacacctgtaatcccagcactttgggatgctgagatgggaggatcacttgatgccgggagttcaagatcagtctgggcaacacagcaagaccccatctctacaaaaaataaaaaatataaaaaattaactgggcatgatggtgtgtgcctgtagtccctgctacttgggaggctaagacaggaggattgcttgagcccaggagttggagactgcagtgagttatgatggcaccactgcactgggcaacagagcaataccttgtctcttaaaaaaaaaaaaagtacaacgcaaaaaggcagatgtgtccctgtagaactttgtcactgtgaagcctagagtagcacagaagattagtttggatgaacgttgtagtgctttgtcacccaggctggagtgcagtggcactatctcggcttaccgcaacctctgcctcctgggttcaagcgattctgctgcctcagcctcctgagtagctggggttacaggtgcatgctactatgcccagctaatttttgtatttttagtagagacagagtttcaccatgttggccaggctggtcttgaactcctgacctcaggtgatctgcccacctcagcctcctaaagtgctgggattacaggagtgagccaccatgcctggcccgttgtagttctttgagcttaaatgccttgcaaagtgcccatttccccatttgatttctcaattattatcctcctggctgggcatgccaagaagaaggctgccagctcaaatgtagggagaccacggctgggtgcaggcagccctgcatgcctgtcctcacagcactgctttctgtgcatttctcttctgttgtcacttactgtcccatggcagtcctgattctttattaacactggagaattgggacagagccttgcacatccctccccatgggactgttgatgagttttcagtgggcttacacaaatactcatttgattgtcagagatgtttaaaccagagcgactccatcttgaataggggctaggtaaaataaggctgggacctactcggctgcatttccagtaggttaggcactgtaagtcacaggatgagataggaggtcacatgatacaggtcacaaagaccttgctgataaaacagcatgaggtaaagaagctagccagaacccgccaaaaccaagatggcgatgaaagggatctctcgtcatccttgctgctcattatatgctaattatactgcattggcatgctagaagacactcccaccagtgccatgacagttttcagatgcaatggcaatatccagaagttaccctatatgatctaaaaaggggaggacacttcagttctggaaattgcccacccctttcctggaaaactcatgaataatccaccctttgtttagcaaataatcaagaggtaacgataagtacaatcagttgagcagccgtcgccactgctctgcctatgaagtagccattcttttgtttctttacttctttaataaacttgctttcactttactctatggactcgccctgaagtcttccttgcatgaggtccaagaaccctctcttggggtctggattgggacccctttcaagtaacatgatgaggtatctaaattaatgcatgattgaatgaaatcggaaaacacattatccaaggaagtcaatcctgaagccccatcatttcagaattaagatgaaacttacttccttttcaattgcctaaagaacagctaccttaaaacttaaaaaaaaatggccatagtgtctaataaaatatgcacccctatcctggaatgccccttttctgtctaggataccttagtcagtaggttatgttccagaaatatgtcaggagccctatcttaagaatgatggtggccgggtgcggtggctcactcctgtaatcccggcactttgggaggcccaggcaggtggatcacttgaggtcatgagtttgagacccgcctggccaacatggtgaaaccccgtctctactaaaaatacaaaattagccgggcgtggtggtgcacacctgtaatcccagctacttgggaagctgaggcaggagaatcacttgaacctgggaggtggaggttgcagtgagctgagatcatgccattatgctccaacctgggtgacaagagcgaaactccatattaaaaaaaaaaaaaagagtgatggcgttatcaggggtggttgtcatggtgtcaggaaagtgaacttggctctccaaggctttctctttattcaagctcagaattgcagagggataggcatccacatagccttgagtttgggaacactgctttgcaatggggcgacgagaattttatcagaaagattgcaggaacagaaccacagtacacactcagagtgaggggcttataaggagaagatatcccatcgttcattgttcattgttcattcattgaagatatcccaacatttagttgtcacacatgagcagcctggcagtatccaaagccagaaagaaatgatggcagtgatcatcccctcactagagttttcactaagtccgtgggaggagatttcagccactacatgcttcttctttaagtcagaattctccagcctagctaacaaatgccttcttcgtaaacttacatttcagcctacacacccatggaagagaaaatccctgtgaaatataagggccccttctacgtgctcaagattaaaaaaaaaaaaaaggaaaaagtagctctcacatgcttttggcaagtttttgtaagtatgttgcacagtgaacatttaaagagtagacttttctctgtcctgaatctgtaggaggtggagcttggagtccttggcccaacttgctggttgaaacaacgggagcctgagttggagacagagggccacagagctgctctccgctgcacgccctggcacccagcatcttccctcgtcctcaggctgcccctccccagcccccatgcttggttatcttgataatctgtctgtgtgcattgaggccattctgtccacttctcaaccaagcagggagactacgattggcggagcggaattggccttgatgggacaaagaagccacagtagattcttgaggctgcctgtaccaggggcatcatcacagactctctgaaatgcatgtctaggcttggttcattaaggacctttcactctcttgttttcttctcaaatagaaagcaagccttccctttttcctactcctaatgtccctatctagttaatggtgccaccatttccccagacttccaagttcaaaacttgaagttatctttgatggatgcctgtggccctgtcttcagctcaagcccctgttgtttcaaccagccagtcacccaatcttgttgcttttttttccttccgtgtctctctcctgtctgtccctgtcactctgctctccttgtggcttctgagttctggttctcactatctcaaaccttgattatccaaataattgttttgctgctccagcctccatccccacaatccaagggttgggtggatggtggaaggatactatgatttgccatggcagcatcggcgggatgtggggaggataaataatatggtataggcccccgatgtatggactccctgatatatggacttcttgatatatgggccccttgatgtatggacctgctgatgtatgaaccacctgatgtatggaccagctgatgtgtggaccccctggtttatgaactagctgatctagagaccagcagatgtatggaccagttgatatatggaccagctgatatgtagacccccctgtgtatggaccagctcatgtatggaccccctgatatatgggccagctgatatatggacccctgatgtatgtatggaccactgatgtgtgaagctcctgatatatgaccccccaatatatggaccaattgatgtataaacccatggatgtatggactcacttatgtatcgaccagatgatgtatagactccccgctgatgtatagaccagctgatgtgtgcagctgatgtatggacccgctgatgtatggacctgctgatgtatggaccattgatgtatggtccagctgatgtgtgaacctcctgatgtatggacccctgaggtatgggccagctgatgtatagaccagctgatgtatggactcattgatgtattggctcactgatgcatggaccagatgatgtatggactccctgatatatgagccagctgatgtatagaccagctgatgtgtggaccagctggtgtatggaccggctaatgtatggacctgttggtgtatggacccctgatgtatggaccagctgatgtgtgaacctcctgatgtatgccctccccgatatatggactagctgatgtatggactccctgatgtataggacagctgatgtatggacccgctgatgtataggccagttgacatatggacgcactgatgtatggaccagctgatgtgtgaacctcctgatgtatgcctcctctgatataggaaccagctgatgtatgggccaggtgatgtatggacccctgatatatggagcagctgatgtatggacccctggtatatagaccactgatgtgtgaacctcctgatgagtgacccaccaatatatggaccagttgatgtatggacccactgatgtatggaccagctgatgtatgcacccactcaggtatgcactaacagatatatgggccagctgatgtatagaccccaatgtatagaccagctgatgtgtgaacatcctgatgtatgcctctctcccaacctgatatatggactggttgatgtatggaccccctgatgtatggaccagctaatgtatgcacccacttaggtatggactaactgatgtatggggcagctgatgtatagacccctgatgtatagaccagctaatgggtgaacatgctgatgtatgcctctacccccgacctgatatatggactggttgatgtatggacccctgatgtatgggcctgctgatgtttggaccagctgtggctctccactcactctggaccttccaccctgttcctcacctgtacactgttcctcctggccatttgagtgcctgacagcccttcgggacccagcccaggggttacttcttcttgggtgcattttcttcaaaaaaattttttttagagatggggtcttgctatgttgcccagactggtctctaactcctggcctcaagcaatcctgtcccaccattgacccatctgaagattggagagaccttaggcccagggctggggaataaccataatttgctcttcaattattctgcaaatacatattgagttcccacagtgatgaacacagtcctaagtactgagatgcaatagtagacagaatctctgtcttcatgaggctttcatagtcctaggaggagatacgttacattttatttattcatttaaataagtaaaaatgtgatgtgacatgacatgataaatcataaagctatgtataaagaaaaataaagccagataaaggaaatacaaagtgaatgactggacaaatggccaacaaacaaataaaaagaggctccgtgtcattagtcatgagggaaatgtgattcaaatccacagtgagctcacacttcacacccagtaggatggcgatcataaaaataaccggaaaataacttttggcaagaatgtggagaaattggaaccttcctacagtgctggtgggaatgtgaaatagtgcagctgctgtggaaaatagtttggcagttcctcaaaaagttaaacatagactcaccatatgatccagcaattccactcccaggtagatgcccccaaagagctgaaaatatgggtttaagtgaaaacttgtccacccatgctcatggcagcactattcacaatgactgaaaggtggaaacaactcaaatcaccatgaactgataaagcataaacaaaatgtgatatatacacacaatggactatcattcagccgtagaacagaatggaggaccgatgcaggctacctcatggacaaacattaagaatatgatgctgggctgggagcagtggctcacacctataatcccagcactttgggaggctgatgtaggaggatcacttgaagccaggagttcaagaccagcctgggcaacaaaatgagaccctgtctctacaaaaaatttaaaaaaaaaattagctgggtacaacagcatgcacctgtcatccaagctactcaggagactgagacaggaagatcgattgagcctaggagttcaaagctgcctgcagggagctatgattgtgccactgcactccagcttcagcaacacagtgagaccctgtctctttagaaaaattaaatttaaacaaacgaaaaaaattacaatgctaagtgaaataagccagacacaaaaagtcacataatgtatgatttcatttatatgaaatatccagactgggcacggtggctcatgcctgtaatcctagcacttttggaagccgacatgggtggatcacctgaagtcaggagatcgagaccagcctggccaacatgatgaaaccccatctctattaaaaataaaaaaattagccaggcgtggtggcacatgcctgtaatcccagctactcaggaagctgagacaggagaattgcttgaacccgggaggcagaggttgcagtgagccaagattgtaccactgaactccagcctgggcaaaagagcgagactccatctcaaaaaaaaaaaaaaaaaaatccatagagatgaaatgcagctcaggggttccctggagcttgggaaagaggataatggggcgtgactgcttaatgggcagagggtttcctttctgggtgatgaaatgctctagatctagacagtggcaatggttgcatgacatcgtgaatgtacagtatgaaatatcactgcactgtacactttacaaatggttaaaatggtaaattatatattatatgtattttgtcacaatttttaaggagagtcaatgaaggtggtcatggggttctctttgaataggagggtcaaagaaagcctcacaaatgagtggagatttgggcaaagacctgatgcgggaggatatgaaacctcggtgaggtacgcaaaaagcctcccagagccgggtgcagtggctcatgcctgtaatcccagcactctgggaggccaaagccagtggatcacctgaggtcaggagttcaagaccagcctggccaaaatggtgaaaccctgtctctactaaaaatacaaaaatcaaccgggcgtggtggcaggcgcctgtaatcccagctacttgggaggctgagggaggagaatcgcttgaacccagtaggtggaggttgcaatgagccaagatcgtgccactgcactccagcctgggcgacagagcgagacactgtcaaaaaaaaaaaaaaaaaaaaaaaaaaaaagcctcccagcagagaagaaggaagcacaaaacagacagatggctcagagcagcattcatcagaacctggctccaccctcctcatagggcgacttctgggcccacctccctccacctctcttcacctagcacttcctttttacctctcatcagggcatgcactgttgcactgtctcccagacaccctggacccttccaacctgttcctcacctgcacactgctcctcctggccatttgaatacttgaacaccctttggcaccctgcccagggaccacttcttcttaggtgcattttcctttaaaaataatttttttaatagatggatcttgctatgttgcccaggatggtcttgatctcctatcctcaaatgattctccagcctcagcctcgtaaaggttgggtgcattaaagatttgagcattgtgtctacgactcgtcagcattatgacactgggcacttagccccctctgtaagtttctctttcttcatatgtaaaataagggctattgagagaataaaataagatgatcgcaaagtggttgacttagttccccgtgcacaatgggctctcctgaatggtagctctatggccacttcaacctcacccgtaatctgaagcttgaaatttggcacttcattttgtgctgttgataatgttttgtaattatttgataaatgtgggtgggagatacaggataaacaccaagggtgatatttatcttctttgaaactgtcttcccccaaccctggtaactatttgatgcagagcatatataatgcacatgaataaatgtttgactgacaactgattgattgatttggctttatcatcaagtaggtaggaaattttcttcaaatgcaactgcaaaggacaaataataatgtctcaggagagttatggattggcaaactagaaaatacctggtccagccacaatgagatatattgaaagctttcataggcacagatgtttgccaaaaaacacaaaacagcacaattaaaaaaaaaaaaaaaaaaaaaaccaggaggtgtggtggcaggtttttcagaaaaatgactcattctgtaaatgaactgttcttttagttcaggagaccatagttactggtatttgaagaaaatgttaacacattttgcgctagatttaagacaagtctctaatgatgtatcacttagaaagtcatgagtttaaaaaatatgaaaatatgagataatagaactgtatttcacaaaaattttaaagccgaatagatagatagatagatagatagatagatgatagatacataatagatgatagatagatagaaatataaacagataaaaacagtggcacctgattacttgaagagcagccacaaggaaggagaaccagtttagttttattcaataagaacatatgatgctaagatagtgctgggaaccgcttctgtatgagctggtcacgtgaccaacctcagagccactgccccagacagtgaataagaccaaccgactgttttctacctttgtaatctatatacaaccaaatgcgatgcggcgactccaacgaagcatctctctttctcaaacacccagcgctttctccacaaacagagaattgattctgcagctctctctccaggagatccttgttttatcactttattcccctttcagagaaactgtcacaagccctgttcaccagcacaaagctagaaagcagctgccgtttttcagtgattaccggccctattttcttaatcatcctttcaacaaaacaatggaaaagggaagaaaatatttacctgaggaaatccctgatttcttcatgagcgtctaaagaattgaatttttcaaaagcccctcggatgctctgctgagaatttcctaaatctaaaatcctcctccgatagcagctctaagtttgagctctgaatagaggctgtgtgttattttaaccacaaggtttctagtcagtagggaggagagatggaaatgaggtatgctggcaaacacagcccccatccacctcaagtgaatcaagctcacagatctgatgtaagaggttcgaggagatttgaagaaccctcaaaccaacttttcctaaactagagattaaataactgcggaaaattccgaaggagtaagataagacacttatggtcttttctaaaaaaagacgtgttggtatgccctgtcaaatactgtcccaaaagaagcttggtaccgagcctatgtggtcctgggctttggacaagagaaagttacctttctcgtggtagcctttctccacagagaaagggggttaaaagtacaaaataacaaaggagtgtgactgaccaagtcaaatcttttgtgcaaaaacaaaaccagtgtcatgagaatccataggaagttgtagggtaagggaatagctattctggaatgttattaagggaggattaatgtgtgtgtgtgtgtgtgtgtgagcacgcacgcgtgctccccacctcccacacaacttaaaaagcaaagatccaacctcagcttcaaccagttggagatcctcctccttagtattttggcaaatacaaatgccgcctttggacttggaagagaatgatttatggcacacagaatcaacagcaaaaatgagggcggctgaaagggccaacgatcctttacagccagccctttgcagatgccagaggggtttaactccacttttggaaaaaggcaacagtgctcctattaagcagggtcataactcagttttatatagagtcttttatctcaaaggagcttgaggtgcttttgcaccaaaatataaattatcatgtgcactgtcacctcggggacgaaatgcagccctgcctaggagcagttggccaagatgcaaccagtcagtttggagccacggttagacagcaggacaagcggccaggaggcactcctcaaggaggaatgagtgggcctgtccttctctctggtagcagatccttttcttcacacagctcagtgggacctcttcattctgcccatcacttctcttccagagtcgccctatgccctcccacagaggactctttccatcctacctacacacacaaattcaaaatgtgcacttagaaaagagctggcaaacaaagtggtaggcgatggtttgcaaatttgattctgtagatcaagagttggccagccagttgtggtggctcatgcctgtaatcccagcactttaggaggctgaggaggggggatcacctgaggtcaggagtctgataccagcctgaccaacatggtgaaaccccgtctctactaaaaatacaaaaaaagtagctgggcatggtggcgggggcctgtaatcccagctactcgggaggctgaggcaggagaatcgcttgaacctggagggcagaggttgccatgagccaagatcacacttttgcactccagcctgggcgacaagagtgaaactgtctcaaaaaaaaaaaaaaaaaaaaagagttggccaaccatggctcttgggccaaaggcagcccactgactatttttgtcaataaagttttattggtctacaaccacacactcatttacacactgtatctggctgcttctgcatgacagcagcagcgtggaatagatgcggcagagactgtgaggcccagcaaggcccgaactatttgttaactggttcttcatagaaaaatttctgctacagagggttttttgttttgttttgcatgatttttatttttaaatgggtggaagaaaggaataagcaggtttttttttttcaataattcctaaagatcatactatggagagaacatctacttacaccaccaacccatattcaggccttaagtctccaattttcttattcactcatcagagaaagtcttttacacaggtactcccattcctgcatagccacactgatggatagacacagtgtacctgacctcacctctaagaactcaacatggctgtctctcaactggtctctcatatagaagccttggagccctgtcagggcctcctccttgtcattcccaagggtaccttgtctttcaagctctctatggatcttctcagcttcttccttcagcctctcttatcatattttgctaattctctttttgtagttcttaccttagttacacccccattatctatttttgtctttgcctttcttactacactgtgggcttgctgagagcaaacaccacgtcttattcatctttttatccctagaatctaaaacagtcaaagacatagaggggatactctattaacggttatgacaaaaataactcaatcagtcttactccaccagaatgtaatctcaagggtggtgaataaaagggttgcctgatggtctctgaagacgaggttcctaaaatggtcttcctcagggatgaacctggacttatccttctaactcttgcccctgggtggagctgacttttatgcattcttttggcagtcactcattgaattttgaatttcagaaagaagagcctcattgcagaaatacgcatcaactgcagttaggaaaaggatctttctaacagctagagttgtcaggagactctgaagagggtcgtgtttggtgggaaggaggctgggtgtcccctgagttcccttctataataacgaactctaaggcttggtagtagcctgggttctctgatgtgacaccctcagaagacaaagcgatcacatggccacgggatgcagatttgtccccatcaggcccagggcatgaaaggacccagcccgggcatggcaagtggtgttgtcattagcattgtgccattatttcagtgagtgacattaccccccttattcatatccattttcatggtcactttgtggcaaacttgggaacattctgtagtgaacaaaaattgcacagttatcacacatatggccacctcacatctggtgaacgatttccctttggtaaacttggacgtccgccattgcgttccccttccccacagtagaagccaggactctcttttccagctttatttgcagctggggtgcaggcaagtgctacaggccgcacagcaggggcactgcaagagactcaactagtaagaaccaggaggaggcagaaaagggagcgaatctatgctatgggaggccagtgccatctggcagggggacacaactctctggctggtctcagaaagggccagtctggtgtcctgtttggtgtctgcctggccccacctctgtggccacaggggactcagtgtgtcacttgtttagtgctcctggttgtgcagttcccatgcctgcctctggtctcccagaatttctgtgacctagtgataccctttgatgaacgtttttttttctccaacaagctagtggtatcatttgcaactaaggatgtaaatgtgtatggttgatacaggtactgaaaacaaaactgtatagtttctttttgctttcttgaccaactctcaggatttgtctttctggccttgatgcagttttgaatgaatatttgtcaatgtgattttgtactaatgcctggctcctttgcctttgggcttattcttcactctcttcctctttgccttgtgtcatggcattggggaccggcagtgggctggccctgctccttgggtattgtagactgtgttgtggtttccacttgagtcccaccaatgggagacatggtggcaggggaaaaggcaggagggagggagaagccagggtattcttccccacccaacctcagttagtgtctccagcagggctacgtcctctcctttgggacttgagctctgctgggacaggtcccctgggctcagcttctgacaagtgtttctggctctgtccttcagcctcgaagggaggtgaggtagtggcttcctgctatgtctgatctctgcattgcctcactgtccccagtgcacctctctgcttttccttcatctgtgtaaccaattcacttaccaaatttcctctattttatttatttatttatttacttatttttgagatgaagtctcactctgtagcccaggctggagtgcagtggcacaatctcagctcactgtaacctctgccttttgggttctagcaattctcctgcctcaggctcccaagtagctggggttacaggcacctgccaccacgcccggctatgttttgtatttttagtagagacggggtttcaccatgttggccaggctggtctcaaactcctgacctcaggtgatccaccctcctcagcctcctaaagttctgggattacaggtgtgagccaccaaacccagccaaatttcctctattttaatgtttagagcagatcccattttcctggttggaccctgattggtacagttctctataccactccggtccaggttaaagaaccagcatacacctgtcggctggagacgagactgtctgggcagagctttgtgctatttgatagaattccccttcttgctttggacaagatcacttctacagagttgactacaatgaggcaagtgttagcaagccatctacgtaactcttctggcctttttggagaacaagaaacagctttcagagagatttgttgatggaaaaagtcatgattagaaacagcagctgatcaaaaaaaaaaaaaaaaaaaaaaaaaggccaggtgtggtggctcaagcctgtaatcccaacactttaggaggacaaggcaggtggatcacctgaggtcaggaatttgagaccagcctggccaacatggcaaaatcccatctctactacaaataccaaaattatctgggtgtagtggtgggcacctgtaatcccaggtactcaggaggctaaggcgggagagctgcttgaacccaggaggcagaggttgcagtgagctgagatcgagccattgcactccagcctgggtgacagagtgagactccgtctcaaaaaaaagaaacagcagctagctgaatccttgcctcaaggaccagaagatcccacaaggaataaagcaaggtaaagaaaagagggaccaaaaaggggtgataaatattcagcctgcagggaatttagaaaatttcgtcagctcttagaaaaaaaattatacgcacttttctatctaattcatgagaggggaaaaagactaagtatgcaaagtatttgttgtggcattatttattaaattaaacctcgatgtccaacactaagaaaattatgattttcatcgtaatacattttaccccgtggaatagtttacaaccaatagcagggttaattatgaagggatgtagcaactgaggaaatagttacagcaatgttaaataaataaaactagcagaaccagacaatgtatcggctctgtgatcacagccatttagaagcataaatgtctatggataaactggaaatggggtaggagaaggaggagttgatatgcgaaggtgatgtgatggtaggtgtattggtttttatgaaagtgcctttgtttttgtaaagtttttttttttttttagatggaatctctctgtcagccagcctggagtgcaatgccatgatctcgcctcattgcaacctccgtctcccgggttcaagtgattctccagcctcagcctccccagtagctgggactagaggtgcgtgctgccatgcctggctaatttttgtataggatgtttgtacaacaataagtactcttccattcccttctgatatggtttggctgtgtcctcacccaaatctcatcttgaattgtagctcccgtaattcctacgtgttgtgggagggacccggtgggagataattgaatcatgagggcagtttcccccatactgttctcatggtagtgaataagtcttacaagatctgatggttttataagggctttccccttttggttggctctcactctctcttgcctgccaccatgtcagatgtgccttttgacttcctccatgattgtgaggcatccccagcaacgtggaaatgtgagtccattaaatctttctttctttataaatgactcagtcttgggcatatctttatcagcagcatgaaagcagactaatatgccttcccatccttttcctttcctttcttatctagggtcttgtaatactaagtgataacaagaaggaaagagtcggggctgagaggcagccaatcaccaggatttagggcacagggaagagggcatggaggcagcaaagagtattaagaagaagaaaattaaaatagcagaaactagataatatgaaattttagtgattcttagggcctatggaggaagaagaacatgtaggattttaaaatttgggctaaataactgtattagttcgttcttgcattgctataaagaaataccagagactgggtgatttattaaaaaaaaaaaaagaaaagaaaagaaaagaggtttcatttgttcacagttccccagacagtacaggaagcatggctggggaagcctcaggaaatttacaatcatggtggaaggtgaaagggaaggatacgcttcttacatgtgcagagcacgaagaaaagagagcaatgggggaggtgctacacacttttaaacaaccagatcttgtgagaacttactcactatcaagagaacagcagggggcaagtccgcccctatgatccaatcacctcccaccaggctcctccaccaacattagggattacagttcaacatgagatttgggtggggacacaaatccaaaccatgtcaataacatattgtagctttcattttcaatattttacagtttccatgttatcggcatagcagatggtgaagctgtttcttgccacaatgaccaggtgaaaaaactgatgctaagagaagttaagtgacctgctcaaatttataccactagcaatggcagagctaggcctggaaataacttcttgggtttcaagtctaacgtattggcttccacaccatgtttgcttctaaacaactaaggtagtggttgatcaaaatcaatgtccccaatggtcagaagtggcactgccccttgatcagtcttgagacatccttctaagtgtccttgagttgctttggcagaacacagcagtgtgttcctgcctctctctctagataaaagttgtctctggagcaggattttcttatgtgctgctggggaggcttccggttgtttgcagtagctctctctccacatgttaattcccaggctgcagaaaacctgctcatggagaacatcagctgctttaggaaggctacaggtaaaaagggctgcctgcattttgggaggccgaggcgggcggatcacgagttcaggagatcgagaccatcctggccaacatggtgaaaccccgtctctactaagaatccaaaaaattagccgggcgtggtggcggacgcctgtagtttcccagctactcgggaggctgatgcaggagaatggcgtgaacccgggaggcggagcttgtagtgagccgagatcgcgccactgcactcccgcctgggcgacagagcgagactccatctcaaaaaaaaaaaaaaaaaaaaaaaaaggctgcctgcaagataataggagacaataggacccctcacaggacaggtgtaggattaaatgtttttaaagtatgtgtataggaattcatgcaacgcctaccacatagaaagttagctacctagctggtagtaagagtcccactagtcataaaaatagggatagcagcaagtcattaaggggctagggttagagaaatagcccgatgacataatttccttctgaaattaggactaggagaaagttttcttcttttctctttccaaaacttacattctaactaacccgtgtgacttttttttttttttttttttttttttttttttttggagatggagtcttgctctgttgcccaggctggagtacaatggcgcgatctcagctcactgcaagctccacctcccgggttcacgccattctcccgcctcagcctccggagtagctgggactacaggcgcccgccaccacgcccggctaattttttgtatttttagtagagagggggtttcaccatattagccaggatggtctcaatctcctgaccttgtgatccgcccacttctgcctaccaaagtgctgggattacaggcatcagccaccacacccggccccatgtgacttctttttagccaaagttgcaaggagactcaattaattcagcttcttgtcatttttttttctttttgagatggactctcactctgtcgcccaggctggagtacagtggtgtgatcttggctcattgtaacctctgcctcctgggttcaagcgattctcctgcctcagcctcccaagtagctgggattacaggcacatcccaccacacctggctaatttttagtaatttttagtatttttagtaaagatggggtttcaccatgttggccaggctgatctcgaactcctgactgcagggtgatccacccaccttggcctcccaaagtgctgggattacaggcatgagccactgcacccagccttgtcatttttttgatgtcccatttctcacctttttaataacttgcctcctaccttgggtgttgtaaatagtttgacattaaatcttttttgggaggagatgggatataagttagttgattatgaaataaatcaggtagtttctgtgcatagctcagctgacagaagggtcatctcccttgtctccttgttatattgtgaatcaataaatttacaccacgagtgtttaatccatatactgagtataaacaatatctggtaggtcctattaacttagttactgttcaataagtgactcccgccaataccataaagattaactttcacaagagggtgtgcttttctaaatttctcccttatgttattctctgggaaaatagactcaggcttccttggtgaagaatatgtgtgtctgtgtgtgtgttgtgtgtggtatgtggtttgtttcttttctgagtgtacattactatatttcagggcacagtttaaaactgtgaaaggtaaataaatctgggggccccaaatcagtaagctaaagggaaaagtcaagctgggaactgtttagggccaacctgcctcccattctattaaaagtcatccctctgctcactgagatggatgcatatctgatggcctcctttggaaagactaatcagaaactcaaaataatgcaaccgtttgtctgtcacctatctgtgacctggaaggtgtctctccactttgagtcttcctgcctttgcttcaagtttgtcccgcctttccagactgaagcaatgtacttcttacatatattgactgatgtctcatgtctccctaaaatgtataaaactaagctgttccctgaccaccttgggcatgcgtcatcaggatttcctgaggatgtgccacgggtgcgcattctcaaccttggcaaaataaactttctaaattaactgagacctgtctcaaattttcggggttcacacaacttagcatcatctagtcatttgtgtattcacttggtaggtacttatttttcccctgctgtatagcaggccctgagctatgtggattccccatgatgtttgcaagtactccatggtcaagccttcctccaaagtcaaacaggggctagtggtgggccattcatttttgtacttgctgtctgctgtttggccttgtaaattgctttttttctgaatgattttctgtctctttcatcagaatatggccccctctagagcaaaatccttatcttgttcatctttgaaggcccagtgccccagtacattgccatagacgtattaggttatcaataaactgttttattgatattgatatcacatcatcccagtagtttgaaataaaacaagaagatattacatgggaagtaaaatttggtgccttcaaacaacaacaacaaaaatggtcatgtggacatattaaagcgtatccaagacccatgatta

SEQ ID NO: 1120 - DNA, 69709 bp, Homo sapiens
agcagacaagaggaagaagaaactcctcaccaagccagaatcaacaagatccacaggttaggaaggaaattataaagatcaaaacgctgggccacataggaggttcttgctgaaaaaataagatcttcagcgtctctctttagggagagatgacaaaaatggcacaggcacaatatcaataccataggggtgaggatttgtagacagctctgctgacacttggtcaggggttcagaccctaacacccaagttttattagtcacatttgcagagggatgtgttttatgctattttctatgctagtgatacagtctgattaattaattcacatattattccaaccagtggccctgatgactcaggacaccaatttcaagcctgcggtcagcaagaatggcaatctgtgagaatgagctcaacaaatgctaattgggccatccaaattctgaaccgttgaccttagtccttaatcaacaaaagagactgaccgtattcaaagaaacagcaaatttgcctttgtattatgtgaaagaaaagtatagctgttttgttatctaagttagaaataggtcctaaaactgtgagttttaaacaccagcacatagacaacttgaaatattgtttaaagtatttgaaataaatatggtttatatagacagttacttcaacaaggcatgctgtgcagcttcaatcctgctgttcagtgatgcttcaatacccttttgttgactattcaggaaattcactataggctcttttgctttcttcatactcactcagcttgcttactttcagcagttgacttaatcttttattatacaagaaaatataaattattagttttaagtttcctgtcatttgcctcaaccccagtcagcctctcacctcaaaatatatttgcctatacctttgtctctgctgctgaatctgtcggtagctcttcccacctctttctttctcctcttaggaagatataatccttttgcactttgaactaagacttattgacatgtacttcttttaacttacacccaagttaaaaagtcaaacaatgttgaaaggttaattcaaaaataatcaatcctttggttttaaccctttcaactctttcagctattttttcattcatttgacatttcaccttcacattttaaaatagaatgcatgcagcacgttctcttgaatcattcatgcaattgcccaatagagttataatcagaagtgtctattacatttatattaagcataagtatgtaaatttcattcacagctgagccaagtagtgtactgtaataacatttcctttatcacacaacttattccccccctggagaagtgcttaactattttttaaaaaaacacatttttgagtctggttctgatgcttgcattgtctcttcacactgagttctttctttctttctttcttttttttgccttttagcatgttttgtaatttttggctgaaggttagacatgatgtatcagataaaatgaactaggtagacaagcccaaaagtgtgaggcttatgtttatctggctaggaattaggttgtgtttgtttattatagctgtggtatcagaggctaaaattgcctttactgtccttgtttttgtctctcgtattgtttttgggcttccctagagacttcttcttaaataggatctgaagctttagctgtatttccctgttattatacagaagccctactgatgtggtggttaggtggggagtgataagatgtggggaaatgggaatcattctatagtcctatgattggatcacagtcttttagtgagtctgaatttggcatttctctttcaccatattggagacttgggtatttactttgcccaactcgtatttttaaggcctccgtctcctcctttcttgtcttagtatctcagatcttgattctttctggaggaatgtcaggtaaatcatcttgcttctcattcatatgtccctcagctaactcacttaccagcaattcatattcatttcctttccatatgctaacccctctcagtttcattgaaaatagatgtgtctgtcattctcctcattgtatttggggaaatttttgagagacgaagggaatagaaacatcttgactccagcaattcaatgccctgtgtccctgatgagcctattcccaggttctagacagaagccttgtgtcagggcatgtttagttagtgtccaaatcaacatcaggctatggaggcgggatattacttaggaagacatggaaggtgatggagagtgcaggatccaagctcttggcttcctgctccacttggaagagatgcagccacccaggaacagtcagatttcccaggatgcagaagcaacaaaaattgaatctagtggctccacagtctactttagctccagggagctctgcagaactatatcttcctgagaacctatttgcaattgtcttaatgtctttttggacctcctttttgttgcctttttagtagctttttgtccaccatccctgatgcactggcttatgttcccttctgcaccatgacagtattccagctgcatcctcttgtttttctggtcttcttactggttccaggtttaatatcttgggacactaaaagtctacaatcagctactttagatcacagctggtgctagttaggctatttgcttcatcttcccctcgaaactccccattctcattttccttaacctttccttctcagcacaaaaatatgtgcagagttccccatcttgaaaaaattttctctgaactctgctaactcgacaagtgacattctttctctctcctcccactggcaaacttctcagagaagtgtacatctgtggcctttgttttcttgccacccacagactctcattaatgacttacattgtaatctggctttagtccccattacaactaaaaatctgtctccaaagtcaccaaatgaactaacttctaggtcaattgtcttttctcaacaagtttcatcatctccccttttaaaaatactcatctcctaagtttgaaaaacacttcatcctgggacttctggaactcctctgtgggctcactttgtttggactcctttcttcctctaccccacccattcaactcaatggagacattcgccaagactcagcccttggcttttagttgtttcttttttaatatcctcatcttatgtgctagcctcgtatcaacgtttctggtccaaatccccaggctgtaactgcctcctggcttcaattctatagttccatcatatgattaatatctttacttatatctttgagtgacacttcaaattcaatatatttaacactgaatttatcttttgctcaaattagttatacttctgaatgtacttaaatatatctatagtcttatttttattttcaattaagctcaaaacattaagatcatcttttagtctttcatcttctcttctctcttatgttcaatcagtctttttttgaatcgccttacatctttcccttccttttctttacaattttcaccatgctaggcataagcctttcttaacttattagccaggttactgtagtttctttcaaagtggtctttcaggttctagcatctcctcttttaattaatcctgcctgtcactgccaatcaatagattggttaattaatattgcctctgtcttaaaataagttgaggcatactgcaatttgccattgtaacttcactagttaaaaaccctcagtggttcctgagttgagttgggcgcttacaggtttggacttcaaatcttggaatgtaaatcacttccacatttctcttacttgcaaataagaagaatgaggatactagtgggtggaagtggctccctgatgcctccctagtccttcacaaaggtgcgcctggtatttggtagttctggaaatctctgtggaatgaagaatttgctagatcagagaagctcagaactccagtgttaatccttcttaacccttttgggcttgttagaggtgtactgggagaactggggaatgttggcatgtaagctattcacagttacatagttttgtgttctgtttattgtcgtaacatcagttcttcctgaggtttttcagtagagtaggcttgggccgtggcctactgtagtcccatgtaggatgtcaaatatggttttgttgtgaccactttccttttctgtgctcagggcagacattactaatcaatcacaggctcttttcctaagccgggttgtagctttagaatcctcaatattctgttttggccctgaggaagggcaatccatcccttaccaatgggttcattcatccactccttcattccacaaatacgtagagagcacctacagtggacgggtaccatctcctaggtactggagatatcgcaaagaaaaggccatatgtccattactatggagttcacattcttatgggaaataaaggaaataagcaagtaaatgaacaagataatttgagacagccataggctctatgagacaactaaaacagggtactgtagttgagaagaactggggtaactactttggacagagagagcagagaaggttaaggatatactttttgtctgggagctgactgaggagaggcaagtggtttcatgaagagcattccagagatggggcagggcaagtcaaagacgccaaagctgggaataagtttggtttgttccaaggacaactaagaggccagtgtggctggagcagagtaacgagcagggagatgggtagaagaggacgaaaagcacagccgaggaaacaatcaatagattgaagagacagcctacagaattgcaaaccatacatctgataagggttttaatatccaaaatatataagcaactcaaacaactctatagcaagaaagcaaataacccaattaaagaatgggcaaaggatctgagtagacatttctcaaaaggagacatacaaatggtcaaatctatgaaaaaatgctcaacatcactaatcatcaggcaaatgcatattaaaaccacaatgagatatcacctcaccctagttacaatagttgttataaaaaaagatgaaagataccaagtgttgacaagatagagaaaaaagaaaatccttgtatgccattggtgggaatgtaaattaatatagccattatgaaaaacaatatagaggttcacccaaaaatttaaaaatagaaccaccatggccaggcatggtggctcatgcctgtaatcccagcactttcggaggccaaggcggacagattgcttgagcccaggagtttgagatcagccttggcaacatggcaaaacctcatctctacaaaaaatagaaaaattagccaggcatggtggtatatgcctgtagtcccagctacttggggagactgaggtgggaggattgcttgagcccgagggacttgagactgcagtgagttgagattgtgccattgcactccagcctgggggacagagtgagaccaggtttttttaaaaaaaaagaaaaagaaaaaagaatcaccatatgactcagcattcctaattcctattacgggtatatatccaaaggaaatgaaatcggtatgccgaaggaatatgtgcattgtgttgtttactgtattaccattcacaatagccaagataatgattcaatctaagtatccatgaacaaacaaatggataaagaaaatgtggcatatatccactatggaatactagtcagccttacaaaaaaaaggaaattctgtcatttgtgatgacatggatgaacctggagggcattatgttaaatgaaataagccatgcacagaaagacaaatactgtatgatctcagttatatgtggagtctgaaaaagttgaactcacagaagcagagaggagaacgatggttgccaaaagatgagatgtgggagtggaggggtggggagatattgcttgaaggatgcaaaatttcaattagatggaggaataagccaagagatctatagtgccacatggtgactatagttaataacaatatattgtatttttgaaaatctcagagtagattttaagtattcttctttttctttcttttcttcttttcttttcttttttcttttttgaaacagactcttgctctgttgccaaagctggagtacagtggtgtgatctcagctcactgcaacctccgcctcccgggttcaagtgattctcctgcctcagcctcctgagtagctgggattacaggtgcctgccaccatgttggtgaatttttgtatttttagtagagacaggagtttcaccatgttggccaggctggtctcgaactcctgaccttaggtggtccacctgcctcggcctctcaaagtgctgggattacaggtgtgagccaccacgcccggccagattttaagtcttcttaccacaaaaaaaataagtatgtgaggtaatacatacgtttattagctcaatttagccactctacaaatgtgtatatattttaaaataacatgctgtacatgaaaatatatataattttttgtctgttaaaaattaattaattaattaattttaaaaagaggagggcagggaatacttgtgtattttgttaactggacaaatgaaactctactttcatttgctcattaaacaaatacttgttttgtgctcagcatgattctaggcactgggactactgcattttggtccattacttccttgcgcacaaaaaccctttcttttcaccacgaatacactatgaacatgtttttttcttcagtgttggcatctcttgattccttccctccaggtctttgtgcgagttttactctttaaaccccagatattgtcatatttttctctgttaaacttttccaaacaactcaaaatagggtaatttcttcttcttctgaatttctctgacaattattctatgggtcatttattaacacagcataatcaaacaacttatttattttcatctttcttgatcctttcttcagttggatgttgtctttgagggcagaggttgtcctctatgttttgaagtctccacacagctcgtcgttgccttgcccgtagttgtagctcagtgaaataaaaatatgtccgtagaaggtgatgtctgtgactggtgagctgagagcttgtggggttggtgttgtatttgggtgcatgtgaatcagtgcatctcctgctccattggtgttaaaaggctcccatcgtcctgggaacacaataggaaagagaacaggtgggaaggcactggatgaaggaatgtggagaatggaggaaaagttgatcagattgttgacaactttcagtgttgaaattgtcaccaaaatcaaagtcagtaaataaatttacaatgtccttttcttcaatgcatcaataacttcaccttcctgttcaaagcacagcaagtaattaatctcttatttgcatttgaaacccaagtttcagatgtttgaaggtggttgtaaaaaataaaaaccaaaataaagccaaaataaataagcagcagcactaggccgggcacagtgtctcacacctgtaatcccagcattttaggagaccgaggtgggtggatcacaggagatcaggagtttgagaccagcctggtcagcatggtgaaaccctgtctctactaaaaatacaaaaattagccaggtgtggtggtgtgcccttataatcccagctactggggggctgagacaggagaattgcttgaacctgggaggcagaggttgcagtgagcagagaccatgccactgcactccagcctgggcgacagagtgagactccgtctcacacttgtggaacccagaacttagtaaccatgaacagaaccttaataaacagaaagttctggaaataaagtttaatcatcatgcaatctttatcactgggttaaatgaacaatcatctgggaacatgtcttggaatgcttaaagctttgagatgcatgtgcctatgtggcagacaaatttcaaatgtgaaacgtttagttaacttggtcttgctttttaatcactgctttaaaatttaaaaaatgctgctggtcaagtaaaaatagcaatagataaaatctgccctgagcaaacagaccatacatcaataaatgaatacttagcttaagcgattttccatgagacccatgaagcatttctaattgaaacttaacaagctacaacccaacagacactccaatcttcacttctagaagggaaatgtgatactccatgtagacgtagctttttaaatttagctggaagacagcgtgacagtgaagttgtgtgctgtaattttttaaaattgctgaagtgtcatggtttgctatttcgtatttattgaaaaaatgtaaatgctatatttaacagaatggcagtaactctgtttcaatctgaagacttaatcttactaatcatggtaatatatgctggctggagttgggaatatttcataaaatactggaataaatttgtgcttatatttcaggggaattaataaaagcaccttcatctgcaacatttaaaatgttattgcctttaaatttgtattaaataatgcagggaagatagatcactgggggagaatggatgcacctctgtgaggatcttggtcattcaacacacgtgtacgggtgaggaaactaaggcacgacttactgggtagggaggtagggatattagcaagatccttcacttgtctgggctttctgtctttgagtcacctttgcgcagtttttcactggacttcacaagcctctgaggcggcagggcagacaggacatccttattttatagaggaggaaacttaggcttacagaggtttcctgccccaaatcacaaaggtggagcctagaccttctcagtctccaccaactgtatttcggttagccacaatcctatctacccacatccaaatggacactgtggctctgcaacttctgtcaaaagggctctttggcaacaggaaaaacgtcatggctccattgtattgtagaggatgggaatgggtgttccggctaaattctccctcccctttccctccacagctcagatggcaaatgtgcgacccagggacctcccgctccagcagacctgtgcgcacaactttgcacagattacctgctaagtcagagccgaaaggtaacacagatgccaaaggataataaaggtgaatgagatttactcaaaattggaaacttggtgtttggtttttcaggagaacaatcaacgactgtgatttgaagttcaccagggtattctgagagatctaatcaaagatagagtgctggtttgaaattattaaaaggtaacagtaaaagggagagcaaaaccccagtcccaacgcaacccataaatctactttgtcttcctcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcggggaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccgcccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacagagggcctccacaggggccagggggaagtgtgggaactgagtctcccccagacgaggcttcacttggacacgtgtatgtggtcaccgggggaaactgagcagttctgacttcccttggaaggcgtggaattaggagagaaatcccttagtgggcacacgagtgagtgccccttggagtccatctgtggaaaggaagcggtgataggtttccgcagtgaggaaagaaactcctttctctgggtgtagaggaattcctagaggtgagggcggggaggatttgctaggagtaactgcaggaagagaatgagcagggtggatgaaagaaacacgtttgttcttaagccgcacagatagcattactctctggagctgtcacgagttcagtgttaatccaataagatctgtcttgcttgtggcacaagttcacactgttgtgaaagtgtcaaaacacaactcccggagagtcagatttaaactgtgtttggaggtcccttctgcggcagggcagggaactgcatccaccaatcttattcaccggggtgtgaagaccgctttatacaatctcaaacaaagctagtcatagaaacacagaaacaactgcagggtgatatagattgttctaccacatctatatttccacagtgctctctacagttgaaagggttcctcacttatgacattgttagcctgataaaattaattgtaacacccttgtgcaaaatattttattaattttgacagcaggaaatattgctatgccatggtaaagttgtctcaagtatttcttcctccttttttctccttagtgttcaaatttaggcaccattgttttggggattcatttataatcatgtcagttgttagtacactttgtacagagttttgtatcacaataaaatattttatgtacatgtataaacattttaataaaagtgtttaaatgtacaacttttggtacccaattctgatcacttgtgggcctactggaagacttatttttaaatttagaattcagccacatattctgaacaaagtcagtactaaaaccatttctaaacacttttaattaaagccatagataatatgggcagagcagtactgggttattgaggtgacttagtgctctgagctgctggtaatgttgtaataatggctaaattagattttatgtcagttccacaaaacctgtttgctgctactggccataaaagaatgttggatttgtttggaaacacattgtgatttttgtgatttcatacttatgtatgtcttttcataaggatgttttagagcggtgattcttatactttttcaatccttttatggatctgaaaaactctaaagaccaccagtgtatggctggtgatagaaaaactatgggaagaatggtctcactttttgaagaaaacataagcaagttatcagttcatactggaagcaaataaatggatcagctggaggatctaatagatcatgcccataaaatctttactttagatttaaatcctacaagttctatttttagagtccctaggataaacttgcatatacaaagtagtcaattgttattatagtgacttataggatcattttattataagataaagacttgcgtgctctctggtgctctggtgttttaaataatcaacatgttttagatctttttgcccactcatggccctctgattaacttctcagttatatttttcaatgcttacacaaaaaatttgccaaacactaaccatccttcctagaaatgcagtggactttgtatttagggaaattagtaacaggtgaatgctccatttgctgatgttgcaaacaaactgttagttggtgtaaagtattaattttgctttcacatttcttttggtttggtgtttagtcattcttgtatcttatttagaagcgagttcccattgtcaaagaaagtatcttgaattaattttgttgtatgagatactttcattctgttttcaatgacctttctcggtgtgtatataggggttgggggaagcgagaatagaaaaatttgagcttacctgaaaaagataaaacattctgcagattttgataaaagggcattttagctggggcttagatattgctgctgtacagatataggggccagttgtgttccgggatctgatgttggtgaaggataaagactggctagcacccttccctcactccctctgtgtttccactaacttacaaatgggctaaggagatcccctgggatgatgggaagcttgacccctcctagagagtcaagaatcattgatggcctggaggacaggaggcagaacaaacaaacagcaggacaaataatggaggccctgctcagaatggaggtcttggtgttctttgtgggttcctcatactggagtgagccttggcaaaaatggtgtgtgtgtgtgtgtgtgtgtgtgagagagagagagagagagagagaggagacagaagagaaggagaagaggggagaggggaggagggacagagagagagaggtctcctacaaagagcttggagctcaggctgctttgctcatttgagtgtaatccaggaggatgcaccttttctctcggacttgaagaccaactgctcagccttcacagctcttgaaacaaagttcttaatgtcccctgaaatcagcactagggactgtagttggggagttcagccccagcagtgcctctgagtctttgttctgtatatgggttctaagaggattagaatcaagttggaaatacacgtgttcccatttcccaccttcaactcccctcaccgcctgagattcttgcaaacatttgtgcaaggaacctgtgaaaaagacttctttcacgtaaggaagtagggctaggagatattaatctgggcattgttgagcattagcatcagtgtgcaggtctcagcccatctgtctgcaatgtttgttgaagccatcacttcttgtcccttgaatccttcctcaacttggatttcaggccctggctctcccttgcttctcctctcagctccctggcgattccctcttagtctcctttgcttgttcctcctcaccttgcctgtaaatagtggagggctcagggctctgtctagattcactccaggccattgctttgaatactgctgcatcccgatgactggagattttgagtctccacccaggtttccccgagcatcagactggcatagacaaccgccttctccacgtggatgtctaatgggcatgtcacatcgaacacatcccaaaccaaacccctgcttccccttctctattatgatgactttttactcttccagttgttggaccccgaatcttaactactcccctttttcatgtcttgtttctaatccatcaacaaatcctgcagctctacctacctccaggatgtgtccagaatcaaaccacttctccccttatctatgactacgatggaggtgcaagacaccatccaaccttgcctgggtaatgggaacagcctcactgctggggttcttatttctgccttgccccctgcagtgtgccatgatggatgctctacagggtgacattatgtgtggacaagacagagtccttgctttttcaaatcccacctgttcttctggagccagctaacacgctcccttgggccccatgcctgaatgccatctcttccttctatggcatcctgcacaggacttcgctttgctcagatgcctcctcccgcgctcttccctttatttaaccatttgtctccattttaccccttcgctatctggggtaatcctgttcccttcatctgtatctctgaaaatggcatcttgccctcccttggtgctcagaaggtggcttctggtttaccgaatagcctgatttcacctttataaactcatgctactagaattttctctccttgtcagtctttctagccactttccaatggaacagagactaccaaatcctaatctgataaggaaaaataggtaaacataacgtggcagactctgacatctgcagtgaaaatttaaggttcatcatcaaatgtatgattccattgtgaaaatgtccagttaaaagctatctgtagtcaccatgcagcattatgaagaagttttcagaataagggcaggtggtaaagtctcctggccagctttaggagtatatattggaaggggctttgttagctgattgaatttttattccccaagtaattagtatgagcgatttgtctactgtatatatgctcaaattacatatactatgcacttttgagaaatactttacaagtttttctttcattaaaatgtatttggggccgggcgcagtggctcacacctgtaatcccagcactttgggaggctgaggcgggtggatcacctgagatcaggagtttgagaacagcctggccaacatggtgaaaccccgtctctactaaaaatatggaaaattcaccagacgtggtggcaggtgcctgtaatcccagctacttgggaggctgaggcaggagaatcgtttgaacatgggaggcagaggttgtagtgagctgagatcgcaccattgcactccatcctgagcaacaagagcgaaactccatctcaaaaaaatgtattttgtacataactagaataatcaactggattgaaagttaatataaattttagaatactactgaattcaatagtgcatttagtcagaaatagttaaaatatctcccaaacagcttgaatcactcctttttgaacacattgttttttgaaggttacagtcaagtccaagaaaaaattttaaaataggaaaagaattaatcaaatcatttcaaaatcatagcagtgttttaacaatgccaattattttgagttgaagaaaagaaggaaaatgtaaactatgcattcaagtaatgtcaatgcaccttctcaggtgcaaaatgaatgaacaattaactgtgccagctgaatatgtagcaatcacggcttttgcacatagaagccttctgaattatcttatattctcaaaaatatcattgctctaaactagaattttattataattaatttgtgcaaaagttgtctttctttcaatgaatgttgtctttttgaggcataaaggaaattttaggtggaggaggagaatagaatacatgcttactgggaggacaagtaataataggtgagtaaaaacacacagcttattgaattgtctcagatccacattttctccagaaatgcaaagttatacttgaaatctatatttaaacagataagcagaatgtgacttttatatgctctattttgatgtattctgagtatgaagataacctgaaggatgcctttttcccctctttatcttggggtaaactcttacttacccttcagagacttgactcaaatattttcattctgcaataaccacaggtagaatggatcatttactcagttgtggctctcttaagagcacagactacctatcatatttatttcaaaatttgtagtgcttatctcagtgcttggcacagaggaaagaaatacaatttttaataaaggcataagtggagaggtaaaatacatatttctggtttcaacgtgtccatattctttcttgtaaatggaatattgcgcttgcagtctgctctcacacaatatctgggaaggagttttaaagagtgaggaagaacagtaaagattttcctaggcagatacgttatgtgacctttgttgatttccagagcacataatatcccaatttcatccagtggacaggaaaagagaggaagagggaaaaggtggcctctcaagtgcctgacctggaagctgcacctatcactgtcccttgggcagaactcagtcacatggtcaaaaggagtctgcaaataattgtcccctgaggagccgggtgctcagtgaatgattctattaagttgaaatcagatgggaacagatcatttaggataaccagcaggctctaccacattgcctaactcccaggcatattgtgagaattaaaagcaccttatatatgtcaacgtgttttgaaaaaatacaaaaagctctacaaaagtgagctataaatttatcattaataataatagtaataatagcaaaatacttgagaaatggtcctcttgagctgtttagaaggaatcatacaaatgcattagacatggtagcctcacttaactacttaatttgcctcttctttgaaattatttcaatagcatttgaccaaaaactatcaaatcatttttgaaataacgtatttttacataaaacacattatcaaatatctttctggatccagcttggtggtaaaaagatacatactaaagtttatgactgatataactttatatattgactaaaccaaagataaatattgattgaacttttgtggccccagtttcaatagatttttttattaacattttttgtttgaagtacagatgtcacgtcatccatgaaccggtatcattatagcttgataaaatactcaaactgaaagcagtgatgtacattaattttaaatataatggttaagcaaatgttatttccatatctataagtgcattttatttgataattagaatgttagaatcagaaggaatttggaaaatcccaggttacacttctctccaggacgaactccttacagtggctctcctggggtcagctagcttttgcttgaccctttgaagcaggaggaactcagttccactcaagttgcccccttgattttctctttcatattgaacctgctgctgcacaggactcctccgtgactgtctctttgccttcctaaatctcaaagaataaagcaagtcactttttgacaagacatctttcacatatttgaaaagacatctttcacatatttgaaaagaccagtacgttttgttcttcctagaattttctccttcatgctaatgtctgctccaagaagacatggaggtgactggacatttagtcaggaacatttcttgagagcttaccctgtggcaggcaggtgcaatgttgaattctgagaatatgaatgtaacctttgaacaggtggctctgtcttctgacgtttcaggataaggtggaggagaggagaggggaaagtcgacctatctccccagcggggagggtttagggttgtctgtgggacctgcctctgtctcatcatccatcaccattgtcctgctgatgggtgcagaggactgaggacgagtggttggagttctccctgtgccggaccctgtagagagtccagagccctggctcccaaaggaggcatatttgtagggctcttttcgtgagggtccagaggacggctgcaaagctgcaggggaggatgggggcatgggaggcaagcccgttgccctgtcagagcctcttggggatgctgctcttccccgcctgtcctctcttctctttgatttctcatcatgtggtcctctttcctctgccttttcctctcttcggtgtcccaagttcttccatagagacctgtgtccccttgttcccatcaggcctttatgccagccctgcacaggtgcggggacagtggtaggggcgtctcactcccgactcaactacattctcccagaaattgtctgcagtcaaacacaactcagcgtggacattgctcaccaaaggtatactgcttgggctgcacgagagattcagttttctcctatctatctggcatgggctgtgagggggctcctaacctagggggcctttttactccttcctggccagagctgccatttccaagtttctgcactgtcagaaaagagggataaggtaagattcctgccctcatgtcacagattagtaggggagaggtaattgtcaaataattacagtaaaatgtataaatgccttaagagaaataagtacttgcttaggaacctatttcaagaaaggagagataggttagcgttttggggaggtagtacgggagcagtcagggaaagcaatacttgtaagatcagaggctggcaatctttttctgtagagggctaagttttggactttgcagatcctacagtgtctgttgcaactattacacagttctgtggttgcagcatgaatgcagccatgggcaatgtgttaatgaatgggcacagctgtgtttcaataaaactttatttacaaaaataggtagtgggccctgctgctgggcttggcttgctgggcacacaaagtgagaagggcattgtgcctttctaggaaacatcccttgcaaagtcagtacaggtgagacagtgtggccattcccaccacagcatgaggtcttttgaatggctgaagcgtcaggtgggaaaggatgaggagctgaagaagaaagcctgggaatttccaaggcctctcttaacatttgctgtgcagaaccaagcagtgccccaggtgttcagagtaggcttcagcgattacatttcttgttagacactgaattttgttcatgccgcccaagattgcattaacaattttggctgtcaccttaccgcggactcaaattagtttgcagtcagctaaaacctctcaggttttttccccccagcttgtgaattgctgtgaagccaaacatccctgtcatctctttggtagtttattttcaaactttcaatcttattaaatttcatctccaatgtgcaaagataagaggaagtttaccgctgatggtggtttattctttaaaactggacatcagctaaatgtgttaaggtaatccgttagaggaatgttggtacgcttatacagtggaatactaattggttattaaaatgttgatgtatgattattaaaaggcagcccatgttatgtctcttctgtatgaataagtatgtaaaaagtatgtaaagattactgtatagttcatgggtgggactgggctctctctagcctctgtccttcattctccctgccagtgccttttcccttgcagtgtcccttccctggctgcatactcaagactggatttgcccagccaaaccccattaactcacagaagcaagaggaaaaaaataaattcttattagttcaattctccaaattgggggcggtctatttcacagcaataggtaactgacgtaaaaggaaaggaaacaatgaagtaattccagaaaatttcctatagctggaggacatgcattttcatattgaatgggaagaatggggtgggggggtcatacctctgtgttattgcagggtcctggctcctagggacctaggcacctcttcagtcagtgaattatagcttggaaaattggctaagtcggggaactgtacaaggggtcatcactttttatgtagccatgctctatgaaccatctttataactccctggcttctggcagttaagcaccactcactatctggcctctgtaatttcaacttctgaccatccccgtgggtggcaacaagcccagctctgtgacacctctgctaccagcagccctggcctggagagcggtgcccccactgaatgtctcagtgagattggcacccccatgagcatattcctgagggtgcagtgaatgctctttctccctacttgggacttctgggaaacactgtcctctggtgggttgtttgacctcacataatatactggttcttgcatgccagcttctctctgcttcttgattcttttatcagctgttagggcaacaatgtcaggcatttccgcctgctcagcattgggcatccctttttacaggcttctcagagccaccctagcagcaactttaccgcgtctcctggggtccttgctggatcgtgaaaacatacttccggagaaagtgttccctagataatgaattatttcttgtcctgtgttaagttccagttccttggtcaaggaccccagcgctactcctcaggatttgcagtgcatgctcaatcttgaagcaatgttgggatatagtatcttttcttctctatcaggcccagctgtctccaggtgggttatactaggatttaatcctcgttagtgccgggtcagctcctgaggggtgcacctgttgctttttagggacgaggcctcttcagcataaagaagtgctatctcttactagggaagaatgggccacctctgtaagctccaaatattcccaggtttccccaaccggggccttgaccttggcataactgatctgccttggctgagcatttaaacatccctaaatctctgcaagtctatcaggtcctaggcctgctgctaagtttctctactcttccactgtaggagagaaggctgtggctcttatattgagcctttaactgtttgttattggccctcagtttctcattagctctctgtagagtctcaatacaatatatcagaaagcattcaattccatctccttgtaggcagggaatgcctaaatcattgcacctacaatgacattctccaccaggatatttcccaggttactgctgttgaaatatttagcaattgaagcaccatttgtgcaaggggactatctgcccctacacaacactcagaatggcattctctttgctttccagaaagtgaatgagctggttccccaacccctcttgtgttagtttgagtcctgaaagaagtaaatgtcaagataggattagatgtacaagaaatttattggggaaagaattgtgaaggataaaggggaaggagctaggggaggcattgaacctttggatcatgatgtgtgtccaacaactatgaaggagagtgggcagggagaaggatgggctgggaagagtttcagttggcactgtgggtctcagaacaacccaggcataggctgatggggacgccttgagccaatgttgcccattggcggagtccacatcttgctgaaatgggcctgcattagttcccctgccatgtttagtcatctgggagtagccgatgagaatcatgatcttaggatcaactgcaatggcagattcaaaggggtagcaactgatggcctcagtcaactgtgctccttatagcaggaacactgagcagtgcatttcttggccatcacaaagactagtgaggagtgcccttcagagaagggaatgaaaattatttccagcctagaatttgatacttatctaaactgtcaatcattcatgagagtcaaagtcccaaaaaataaatcttccataaaccctttctcaggaagttattggagggtaaccgccacataacatgaggaagacaaggaggaagacatgggatctatgaaagggcaggtctaacccaggaaaaggatgatgaactgtagacccatgatgtcagatgtgcagcagactaagatcagccagtgcagaatgggggagattccagaagtgtgtccccccaaaatattggaggctcatgtgacttccctggggaagtttctgctgagaggctattggaaattgagggaagaattagccacagtcccaaagaaaacagagccaatcaaaaagcaatgcaattatgaacttcaaagaaaacaaaaataagaaggaaaacagtcttacttactacattacaaggtccagctgtgaatgatattcatgttggcagaataatgtcaataccaaatgtcggttaaacccaaaactattgtataactaaattgcctgtgtaagagagctaaacccttatctagcataataggaagtcagtggatacttcctgaagtgtggatgtgtggagatgtaaattccaaaagaaaacgtcttaagagtcaaaagtggttgcctctagagagaactgggggaattgtagggcaatgtaggacagggaactgtgatttttcttgtaagttgttctgacattttaaaccatgaacatatattacttgtatttttaattttaaaaagacataaatattttttctatcactttaaatattaattttgctagttatagcacatatttatagcattacactctgtagagctcttttggattcaagttttggagaattttcaaagttttagattaatgcctttgtgagttttcatccctttgatgataacaagttacaaagaaatagggttatgaataaaccttgtgggatattgttagtcaccttctctcaagtcgatctgtcccatgaatcaatgtttcaaacattgaccagcatttgatacttaataagcaacgagtaagtttttgttgaaccaatgaatactcttaaaatatattttttcaagtggcaacagtactatcttatttgcactctacttttctttttgaccctaagaatgtcacaaaaatgtttagcaactgtcaagattattacatacagagatgactattgtgttctcagatatgctgtatgtcttagttcattttgtacagctataagagtagctgagactaggttatttatttatttatttatttattttttgagacggagtcttgctgtgttgcccaggctggagtgcagtggcacaatctcggctcactccaagctccgcctcccaggttcacgccattctcctgcctcagcctcccgagtagctgggactacaggcacctgccgccatgcctggctaattttttgtatttttagtagagacggggtttcaccgtgttagtcgggatggtctcgatctcctgaccttgtgatccactcacctcggcctcccaaagtgctgggattacaggcgtgagccaccgcgcctggccctattttttttttttttaaaggaatttatttcctcacagttctgttggctgggaagtccaagggcaagtctctggcatctggtgagagacttcttgctgctttctcccatggtggaaggtgagagggcaagagagagacaaaaggaggctgaactcatccttttacaaggaacccatgcctgagatattgaacccacttctatgataacagcattaattcattgatgaggacagagacctcattgcctaattggcctaaagtgagacctcttaaaggtctcgcttaatactattacaatggcaattaaatttcaacatgagttttggaggggcaagcattcaaatcatagcaccatataatacaataaaaattttctgagctaagtttggtaaatttattctaggaatccatgttgtctcctagttatcttcccttccatagtactgatgcatttttgttaaccattacctaattttgcttgagtctattatttctgaaattcacattatcttcccttttaaagttgagaaaattttcattcttcaagcgccttattttctataatctctcaaagtaactgatggctgttgcatgatcataagtgcaaattattttgctagaccacacttggagatgatgaatttggaatggcatgcagactcccgacatcaggagtcttgtctcctgcaataatcaggaacccaggcttaaaagggagcaggtacaacagaagggcaaggggtgacaatgctggtgaaagacatttgaggaaagctatcaacatgaaacagaataaaataaacagaaaagcaaaccagggaaaataaattatgcaggaattaaacacatacacaaactgaaacaggaaccatcagaacatataaaaaattcttgaacatcagtaacacaatagttgaaacaaaatatttagtaaaatatttgaaaagtaaggtcaaagcaatgctgtaaaagtagtacaagatgataaagaaatagaacacatttttgaaagggaaaaagatttaaaggatattcataaagatccaacatcagactaatagaagttctggaaagagagaataaggaaatacaggtcaggaaatttgtaaagaaataatataataaaatgccccagaactgaagaacatgagcttttaactttaaagagccgactgagttcctagctcaatgaatgtatagacatgtaagggtattgaaagttcaccttcagtgtcatgtttcctaagaagctaatggaagatatgcaccagcaaaattgtagtaaatacataggaagaaatagtatatagaaaaagtatggtttcaatccataagaaataaaggaaactcccaggacgagagcagctcttgacagcatctagtccaaactggacttggaggctggaaacttctagcagggaaggaagagctctgggtgaaaaagtagactcaacagaatagatacgatcatagaaaacatgatagagaatcactaacacattgaaaaaatcacatatagaatattctgcacgcttaataatgaggtcattatttattcaagggaaaattaaaagctgtttagaaaagggaaatgttatagtgccctatttggctctaaaatgaacatttatataggaatcttcatgtaaatactaacaatgatttaaataagaacagacatttcggaaaataagggaagaaaatggggcatgtaaaagagctaactcctcattatcctaatgaattattaaatttcacaatagcatagtatttagaaatatgatagttattacgagaagaaagagctaaaaggttgccagtggggagcaggagtgagggttagagacgggattgggggagatgcttactgttttcatgataagcctttggtactatttgattttaaactatataaatgcatttattaatttaaagtaatttaaaaaacccataccactggataatgcttgataatttctagagtcctttttttttgtattttggggcaggtaaattcattgagagacccagagagtttagctgactttcctgtgggtaccaagggtcagagctggggtcaaaactcaggttttctgaacccctattcccagtgtacattccatgactccaggctgcctcccgcattgcacaggttacatctaggggtgtgctagcaaatgcctagaccatcctcgtccacatcagcatctgaaatggacaagaatgttagtcatgacttgccactaacgtctttaaccttaattgacatctgagagtgtcatcattacatcattacaaaaacactaacccagatacatctgttcccattactatttctgcgtaattcccccagacttaattgctttaaataaccattttatttggtttacaaacttatgggtcaggattaggggagggctcacccacgcagtttttctctggtccgcagtcatctgaagcttgaacggggtggggcatgcaagacggctcacacatgtgatccgcggttgagcctggctgtggaccagagcatctctgttggcctcgcttacacaagtggtctcagattagtagcctctgtacatggaaactagcttccctcccggcaagcatcccaagagaactaggaggaagtggtatggacttcttttcttcttcttcttcttcttttcacttattcttgatatcatgtagcttcatttctatcagagcagtcacatgcccacagattcaagggggagggtccacagatccgccaatgggaggaacagccaggttatatcgtaaaagatcatggggcatgggagatacccatctattttctgtaaaaaatacattttgccacagcatcactggctttccagctcacagtgatctgcctggaatgcctttttccgtctctccaggatctacatctttcaatataaggtttagaaactacctcctacaggaagacttccttgatttccctcagcaagaaagaatctttccttcctctgaatcgccattgcattaaaaaaaaaatccatcttctggcgttttcactttcagacttatactgtaattattctatgtacctatgtttgacccctcacgatgcccagcataataatttgtctattgagtaaatatttgcttaatgaaataatcattacatgataactcaaatagcagtcctgaaaaagtgcatttcaattcagatctctcttttttcttccttcacaattctcatttccgaaaaatgaaagaagccagaggatcctttatgaggagttacagtataacttatgcgtggctgtttcctgtgtttactgctactcagtgagaaatacgggagatgggagagtgaaaaaccatgtcatttacaatttgattaaaaagctttttatcttttcctttcacgtttaagccttgccgttttaaaaatttccctttcgtcacaggggatcaagcagcagttaacgctgcagttccctgttctggaaacactctcaaaggtgtttcaacacattttgtctcaactctgactcctgccccgctgccccacgccatccagccacactgaaggtcttgcatttgtgccttggggcattatttttttttactcttctccctgcctggaaggttcttcccaacctgccctaccgccatagccacagaaccaacccttcactttccttaagtctatggtcacaagctccttctcaaaggaggcacacctctaaccacccccatttggtgacttcctgtctcctggaggcccccggaactagtcttctctacttccagcaacccactttacgagcagcggagaagactgactacttctgggggcctcgaggagacaggaagtcaccaaatttacaggtgctgtggatgaaactgtgtgataatgaatttattgggcttgtttttttagcttctgaatagaagaaccaataagatcatttttttaaaaaagataaaaacagacaaacacaaaccctctagtataaaagcatttttttttaaaaaagatgaacacacaccctcagattgccttcttttgaaaaggcaatctgagattccttatgaaatccccagacagaagctgtttctttgaatttaatatgctgtacactgtagagccaagaggcttatagagtgttaattaacaccccttgtcaaacatttgtaaatgaatctggctaaagctcaaggaaaccaggtttttctgtgtgataaaatataatctttggagattatttatgatcacaaagggagactgtacagaaaattttcctagacttggaaatgaggcaggattattggtgtccatctggactgaggcctcaggcaggcctgcctagttaatcccattctcctatcctcattctctgggggtgaagaaggcagtgcacctttgttcaatttgctgcttaccatggattagggcattttaaattctgtaagggtagtttttaacttgtagaaaactgatagcgatgggaaggattcttgcctaatagggacacaaacggattttgttctgtagagatgtaaatgaaaagatgaaaatcacaacacatttaatgaaaggaaaataaagactcttgtgagtgccaccaaaaaaaaaaataaataaaatgtatctcctctccgtggcaccccaggccttccttacctcactctatttcttcatagcacttattgccttagaacattctttataatttacatttattatgtttgttgttggttgtcgctcctcctgctaaaatggaatctccgtgagggcacgggtttttctttgatttgttccctgttgtgccccaaagtgctagaatcatgccaggcacacaatagatgctcaataaatacttctggaatgaaaatccccctccacttagaccagtgagttccaaacttttttgatcttgacccatagtaagaaaggcattttccatgttgaatatacaccattgaaacaaaattttcacagaaaaaacttaccattattacaggcagtgcactgtgatatttcctaatctcttctattttgattttcaaaattgctgaggctactcataggttgatttcacaagtggagtttgtgttatgaaaaactttgacttaacaccatgtcgaaactgctaccacaaaaaggcaaatgcgaaagaagggggaaagagcaggccgatgactttccgctatccaccactccataaagcatatttcattttcctgtaattgtatcctgttcaatgatgtagaaatcctcacacactcacatgccactttttctttgggtgaaaagcgttctctactgcaagatgaattgagttatttcaaaagcaaagagctataaatgagcctgttaaagaaagtctcaaggagagtctgttggcatctgctgttgataacttaaagcaggagaattagataaggaggcagaagtagaatgtttagaaaataaaagtgaccattatagaggaaaaactgcttgtctcagttttgttgatattggagagtagctctttcatgagggtattgtggaattattggcaattatactaatagatgtttactgaaaaaatcctatttgactgatgaaccatggaatacttttgctgaccttgtggaaaacatcacttatctgagttccttatcttcttgtctcttttttctcatctagcctatgcctccctacctgttccctcatggttctcattttgttgctattagaaaaacagagatacaaaaaccaggaattggaacccctctgtgtctccagtaataattctgtgattaatgggttagatggattctggtcacaagctggatattttgttaacaacctagcgtcaatgacttggaatgattttcaccgcagcatgatttagtattgaatagaatgatttaactaatgttaattagttctgtacagataaattaatgaagcaagaagctcaatctctgatttattgatgtatttacccagtgtaagttatgaaatcttttttatttcatttgaaggaagtttttatttaaatacaaataaataagccctttattgtcacctactttggaaaagtccagataaaacaatcttaagtaacaaaactccaaaattacaacatgattttcaaaaactaccctgacctttgtcttgcctggttgttacagtgtacttttaactaaacggattcttatagaatctcaagtttggttatatttgtattaaggaactctatatttgcatttgaccagccctaactaaaacaagcttaaggaagaaaagggactttacgacaaggacaaaggattgaagaagaactccagggactttagatgttaacaactgtatttgtcactaaagtaaccattactgtcaaggtgggttctccttctccctcactaaacacatgcacacacaccacacacacatacacataccacatacataccacacacatgcacacacaccacacacacaccacaccacacacacagaaatacacacagacatacacacatgcacttatgcttgggtcagtttggcttttatcatcccagagagtctcttcccatgtcagcaactccagattcacttcctctcctaatataggacagtcacatgtctctattccagcaaaacaatctcagggaaggtatctcattggcctggcttgggtcattcaacttgaagtacaagaagagaaaacagtattcttttatttttatagatttcctgtaaaatcagtggataatggtaaaaatttcatgacagcaggtgttttaccttatttatgtttactatctctagaacccagtatgatagttcataataaatgcttactaaaacaattatcaaactgtacacttaaaaattaaaagagtaaattttaagttgtgtatgttttaccacagtaaaacaaaataaaataaacctattattgatcttattgtctatttctcaaaagtagcatacgtcataatttcatgtgatttctaaaggagatctaatctcaaacttagttcttagagtaaaataaaaggttttggcaatcatatacagcagtagactttaccttgaagatttaacaaaggtttgaaagcaaaatgctatgatactgaatatactaatgtttgagggcttgtgaaaaggtcttaatataggaatcatatatcttcttttagattgtgtcttggggaacattgggggtcagtttttctatcagtgttagtatgtagtaagtaatggcatacatctaagcttgagattttgctcatttctgtattcttagcacttatatatccaacatataataggtgttggataatatttgttgaataaatgactaaataaatgtcttggcatgagaattatgccatctacaaaaccgtcacttttaaaaaaaacaacaaagatttttgaacctgtagatccagccagaaagcaagaaatatcttcacctttccagactgacttattttttggtctagctgtgtactatgcatgagctgtcaactttaatactttattttttaatgcctaggtctagtgagttacaatgtgatgtagactgattgaattaaaggccccaatgttgtcctctcttcattgtatccatgccttttgtcatgtaactttgcagtgtcctctactctaggtgtccattcagcttatcctttgactctggccttcttctcctttgactctggctttatccatgtgacttactttagccaacaatcataatgctggcaaacactgagaaaatgcttattagtgtctgcttagtctcttgcttctctgcaattgccatgagaaaatgcccaagctagtacactggaggatgagacatgtggggcagaagcaacctgtcccatttgtcccagccaacaccatcctagattaaccagatgagaccagagcagaagacatgttcagtggagcccaacccagctcacgaataatatttcttcatgagcatgtgagcaatgtgtaactaatgcaccatgctctttttattctgcacttccaaacatctctcagattgccctgttgttttgcttttcagtagtcatcacctttgtccagaaccttaattgtatctgcattttggcagtatcctgccaattttccacatccagctgttcacattctaatgcattctgcaatggatgattttgagcatatgactgatcatcactgtctcagaaatttatgctaatctattgtgacctattctgtcaaatccaaataactttacattcaaaacttttcatattctggccccatactgtctattgtaatcttattttctaaaagccacaaactattaatcctgtagcctaattaggttgatatcatcattttcacaacacgttgggtaaattcttatatctgttcctttaatcatagtttccatgcttagacactccattgccctccctaagcaccagccagagtccactatggggggatattttaaaggctcttttcccctaacccatctgccccagaggtggcacaggctagaaaagatagtccaattatttggcttaattatttggatcttacagtttttttgggagagttccagatgatttgatgaaatgcaacatggtcaaaaacattttggtggagaataatttaatcaactagaccatttggtgaaaaataaatcccagttactagacttcccagtattaataattttggtatgccaggaatttttaaaacatttctaacaaattttttcagaaatcagaatgactgaaaggtataacaataggaaattaggaaatcaataagtaatcattgaaaagtgagtgattgaattagttggaacaatctatgccatccatcctgtgggggaaaaaatgaaaacagctaaacaagcagagcagacatcatcaacttagaaaaacaatatagtaaataatttgaactagaaaattttccaaaattgaaaattccagttttaaaaaatttgtgttttcttattcaaaaagcaatacatatttcgttacataaaagtcagaaaatcagagaagcagaagaacataataaatgcccactgtcctactcaatagagactataactgctatctctgtacaaatcctttaaaatcctgtcttatgtgtatttattttacatctgtacatatgattccaaaattaggtaatactgtacgtggtctatctatagctaactatagtttgtaatttaataagctatatttgtccatggtgatcatttattgctcataaaattaataaattataatttatttatcaacactgatcatttgttgctaataatttatttcatttaatgtcttattcctgggttattttaactaatccctattgttagccctttaggttgtttcaactaatttaagaattataaatggcccatagtagttacttaataaatatttgagtgaaaggataaatgaatgaataattccacattattggatgttcaagttgtttccattcaactttattgttgtgggggagtataatacaatcttggtgaagagccaccaacttaggaagaactatgaagaagcatgttatttactcctgcttgtgggtggggtgcattgggaaaggaatgcctaaatgcacgtggggagccaaacaagacttcacaggggagatgggaattgagccaaatttggaagaagtgagaattttcagttgataattggggaagatagtactaagagtaagtggggttcattaggaactacttcttagaagaggcaagtccagaacagaaggcagaaagggatatggatatgaaggaaaagtagaatgcaacttcagggctagtaggttggcatccaacgtaggtacagccctggatgaggagtaatgagaaactgacctggctgtagcaaaacagctaggctgggaagtgatgctgtttacatttatatgcgattctactggtcttcctgttactttgtagaagactgtaaggcttggtgctcagagctagaaatgcaacttatttgatttgctaagaagtccaaagcaggtaggggtgccaagctgctgcctgttcacacatattcgtctaactgggtgtcagggaaagcagatatgagcccccttgcattggttaaatcctgagcaacttttaaggaactgcacacagagactactggctattttttgtggataaagttgtagatagttatttttgggaaattatttatgtgttctattaggtggttgttttgtgggaggctgtttgaaattctgtcttaaggaactgcagcttataaaccatagtgctgatagaaataagagaaataatttggtctgcgagcacaaacatcaggctagttggcatgcttatgtaaacaccacacagtagcagtgacttttaaggaagtcctcagacaatgtaatcccaatactcttcttgaagttgaggtaatagggtgccagaaagaaaaagaaaataaatctctagtgccttctaaaattttttcaatcctttgacctttttgaaaacggtcacctttaattcagaactaaagtaacatctggagggcccttttcttagatagggagaagacataaatgagctatttgaattattttctgcttatgggctgcatttcatttcttccaccattggtctcagtccatttaattaagattatttgtaggattaaattaatcctttaagaattattccatttcaatttttaaaaaatctaatgaatgatagataacaaaaagcggtccattcagtattacccctgaaacatatttgggtgattggtgataccatccatgtctctccaacttcagcttcatatactcagctgagtaccaggcatcttcattgaaagctagacttgtgacctaaatagaacttgatcccttcccttccccaactccttattttttgttttctttgagttccttgattcctcttcccctcctcacatgcaacatgtaacatccaattcatcagcaggttctacagattctgccttcaataatagcctaaatctagccacttgttactatcttttttggtccaaaccatcatgatcttttgcctggaccattgcaatagttgtctaactggtatccttgctcccattttgtcctcctagatcctattttccacgtagtagccactgatttttggaaacttatcaatcattacccagacacaatgagtacatttacatagttgtttgattccatttacataaagtcccacaatcactctatgtactgggaatcacaacagtggtctcctatgttgagaattgattaagagtcacaaggaaacaaggagtaatattccattgtattaacagaccacactgttcatacattctcctgtaaatggacatttatgttgttttcagtttttttgctattgtgattaaagctattaggttggtgccaaagtaattgcagtttttgccattactttttaaatggcaaaaactgcaattactttggcaccaacctaatactgtaagtatctttgaacttaccaatcaaacattactacaacacttgaataagaaacacttccatagcatttacaattctaagtgctttccatgtattgacttagttaatcctcacaaggatataaccatgaggtgctattactatccctactttacagatgaggaaatagaggcacagacttcagataatttgcccaaggtcccacagctaataagggggcagaattaggaaagcctggctgagtctatgctctcatcacttgctcaactctgcctggaatgcccttcccgtaccctctaccgcctctgcccaatcctccgggttctctgctccttccacacacccccatctcaggtcccagtcttttttagcattcttcactttttctgttacagatcctcagacaatgcttccttgaagaagacttgcctgtctaaactgccttcccatcccaatccctgttaccttctatcctttctctgctttgttttcatttgttatctctcttcttcccaagaatgtaagctccataagaacaggatcatattttgaatcccctagaaaagtgcctagtgtaatatttgttgaatgaatatgatccctgcaattaaaagctaaatatatatatttttttaactaacagattactgtagtagtttcaaagatgaatttatgtttcggagaaaatcagtattctcttgccacataaattgtaggtaattatatttctatacctgaatagctttgccaatgactaagatattaatctattatatatttattaatctatagatctttaaaattgatgcacatgttttataagcaatttgatgaattttgatgactacatacacctgtatgtgtatggatatctgtaacaaatatccaagtaaagatatagaatattctcattaccccagaaagtttctttgtgacttctaatcaattctcacctccgtaggaaaccgctgttgtgattcccatcaccacagactgattttgggactttatgtaaatggaatcaaacaactctgtgaatgtactctgtgtctgagttctttcaatctacacaatctttttgacattaatccatattactgcctagaagagtagttcactctttgcattaatgaatagtattccattgtataaacaaaccacactgtttatacattctcctgtgaatggacatttgtgttgttttcagttttctgctattgcgatttaagctactataagcatttttttttaattgtgatggggtttcgctcttgttccccaggctggagtgcagtggcagcgatctcagctcactgcagcttctgccacgtgggtccaagcgattctcctgcctcagcctcccgagtacctgggattacaggcatgtgccaccacacctggctaagtttcgtattttcagtagagacggggtttcaccatgttggtcaggctggtctcgaagtcctgacctcaggtgatccacccacctcggcctcccaaagtgctgggattacagtcttgagccactgtgcccggccagcatctttgaacatatcaatttgtaagttttatcttaatattgtacaagtcttttggggggcttatgttgtcatttctcttggtaaatacctaggtatgaacttgctagattatagagaaaatctatctttaattttataagaaactgtcaaatagttttccaaagtggtggtactatttatactcccaccatcaatgtatgaaatttccgttgttttacgtccttgccagaatttgttggtagtctttttttttttttgaggcagcatctcactgtgttgcccaggcatacaatggtgtgatctcggctcactgcaacctctgcctcccaggttcaagggattttcatgcctcagcatcccaagcagctgggactacagaggcgtgccaccacacccagctaatttttgtatttttagtagagatggggtttcaccatgttgcccaagttggtctcgaactcctggcttcaagtgattcgcccgcctcagcctcccaaattgctgggattataggcgtgagtcactgtacccagcctgttgccagtatttttagttgtaggcatcttagtgggtgtgagtgctcgttggggttttaatttgcattttcctgatagtgttgatgttgaggacatttctatgtgtttactgagcattggtgaagattctcttgtgaaatatctattcaaatattttgctcatggtgggaaggggagttatttttcttttactactgataggtaggcttacgtatttatttcggatataattattttgtcaattatatactaatcataaacaaaaactgataaattggacgacgtcaaaattaaaacctgctcatcaaatgttagcgaaatgtaaaggcaaatcacatactgaggggagatattttaatatatgtatatttatatagtgctttctgtgttctaagaagtattttcctactccaagataaagagactattctcttacattttgttctataagttttatagttttagcttttagctttggatctatgatctgtctcaaatttttatgcaagattggggtttaattttttcatacacttttccagttgtcaaggatcatttgttgaaacgtctttcctgttgccacataattgctttgatgcattcgttagaaatcagttggctgtgggtttattttggaattttctgttctgctcctttgatgtatttgtctatccttatgccaatatcaccctatattaaataattatagctttataataagtcttgaaatcaggtaatgtgaatgtttcaactgtgtttttcctttttctagttattttagctgttttatgttcttattgtatatattttagaatcaacttattcatttctacaaaaagtttattgggattctggatgagatggtgttgattcagtaggtcaatctggggaaatctgataacaatattgactcttccaatccatgaaaatggtatctcattctttatttacatattctttaatttctgttagcaatgtgttataattgtagcaaacttgcacatcttttgttaaattattttctaagtattttacgattttggtaccactgtaagtggcattgtatttaaaatttattttctgtttgttttctgttcatatataaatgcaattgattttcttttttttttttttttttttttttttttgagacagaggcttactttgtcacccaggctggagtgcagtggcgtgatcagcactcactgcagacttgaactcctgggctgaagggagcctctcacctcagcctcccaagtagctgggactatgggtgtgagccagtgttcctggccaaatgcagctgatttttgtattgacattgtattctgccaacttgctaaattaacttattcgttttaatagtttttctgtttttttaaaaatcttaggatttctacacagacaatcatgtttttaatgaacaacaaagtttgtttttttgtttgtttgtttttcccttttcaatcaacatgccttttatgtttttatttgccttactgcactggctaggacctccagtacaattttaatagcaatggtgagagtgtttaaatgtactcctgtgtatattttattcttttggaacttattataaatggaattgttttcttaattttctttttggactgttcattgctattgtacagaaatacaactgactattgtgtgttgatcttgtaccttgcaattttgctgaaatcgtttattttttgcaatagatttttgtgaattctttaggattttccatatgtagaatcatgttatctgtgaatagggatagttttacttcttttctaacttggatagttttttccttcctaattgctctggcaagaacttctagtacaatgttagagagcaatagtgaaagcaggcatcttcctttcaatcctgatgttaggggtgaagctctcagcctttcactgtaatgttggctgtggattttcataattttttgtttgtttgtttttttgtttgagacggagtttctcttgttgcctgggctggagtgcagtggcgtgatctcggctcatcacaacctctgcctcctgggttcaagcgattctcctgcctcagcctccagagtagctgggattacaggtgcctgccaccacaccgactaattttgtatttttagtagagacggggtttctcgatgttggtcaggctgctctcgaactcctgacctcagatgatccgcccgcctcggcctcccaaagtgctgggattacaggcatgagccaccacgcccggcccataaatgcttttcttaatcatattaaggaagttcctttctagtcgtagttttctgagtgtttttattatgaaagactttcagatttttgtaaaatgcttttcctgcgttaattgagataatcatatgggttttctccccctttactctattgatgtaatgcattacaacgattttttttaatgtttacccatctttgcattcctggaataaatactagttgattgtgctgtataattcttaaaatatgctgctggatttgttttgttagtatttggttgcattcttttgcatctatattcataagggatattgatctgtaactattattttcttgtggtggctttatctggctttggtatcaagataatgctggccacattggctaagttagaaagtgttctttcttctattttttgaagagcttgaaaagagtcgtgttaattcttctttaaatatttggtacaattcactattaaagccactagtcctgggcttttcttagtttgaaagtttttgattactaattcaatctcttttacacctagattagattttgtattttttccttagccacttttggtaatgtgtgtgcttccgggaatttggccaggtcatctctgttatctaatttgctggcatccaaatgttcataatgttctcttgtaatcctttttattatagaaatgatatacagaaaaggtcagttaccactttcttttatgattgcattaatttgcttcttttctctttttttctctagtcagtcttgctaaaggttggtctgttttgttgatttttttcaaagaaccaacttttgattttgttgattctataatttttctgctctgtattttgtgtatatccattctaatttttattagttcctttattctgttagctgtgagtttagttggctcttcttttttattttcttaaggtggaagactaagttattgagatatatcttgtttttttttttgatgtaggtatttaaagctataaaatttcctctgagcattgcttttgctgcaatttataagtattggtatgttacatattcagttagttttttatatacacatttaagcttttgctaatctaccttgtgatttcttcattgacttattgcttgtttgagtgtgtcaacaatttccacgtatttgtgaatattctagttttccttttgttattgatttctagtttcatttcattgtggtaagaaacaatactttttatgatctcaacagtttaaaatttattaagacttattttctggtctaacatatgatctatcctggaaaatgtatcatgtgcacttgagaaaaatgtatattctgatttttttaggtgggtggcatgttctattaatatatatgtctgttagctctaggtgaattatagtgatgttcaaagcctccattttgttattaatataaccatgccagatttttaatgctgtccatttgcataatatgtctctttccattctttttcttttacatgatcactttatatttatagtatatttcttgcacacagaatgtaattgaaacttacttttctaaaatctactttcttttttttttttttgagatggagtcttgctctgttgcccaggctggagtgcagtggcacaatcttggctcactgcaatctctgcttcccgggttcaagcaattctcctgtctcagcctcccgagtagctgggattacaggcacctgtatttttagtagagacggggtttcaccatgttggtcaggctggtcttgaactcctgacctcgtgatccacctgccttggcctcccaaagtgctgggattacaggcgtgagccactgcacccagcccctaaaatctgctttcatagcatctgtcttgtacttggaacatttagtccatgtgtatttgaatatttattgatatgtttgggtttatgtttacaatcctgctatttgttttctttttgttccatgtgttttttgttttttatttctgcatcttttggaaaaatcagattttttggtaattcatttttcttattttattggctttttagagaaaccttttaatatctttgtgagttttagggattacattatttattcttattattattccatttagaattaatattgttaatcccattcaaaaatttgtttatttcgcttttcagttctagaattttcatgttttcttcagttgttgtttctctgttgttattctccatttgttcattatatctatcttttctttgaaatccttaaaaatatttataatagctattttaaagtcctctgctaatcccaatgtctgggacatcttggcttctgttgatattgaatacttctttttttccccttaattaagggtttcattttcctgctttttcacatatctagtagatttttattatgctctgtgtgctatgaatgagatattataggaagcctggtcaatattgtctctttttaaagggtgttgtatttagttctgccaagaagttaaattaccagatttacttgatgtggctttagtctttgttagagctggtctattcctgctttgttcttacttctcaggtaatgaccttcctgagtttcagctggatgcctgaagtgctcagctgcatttttctactctggctattctgaaatgcaatattttccagacctacccaacctttggtattcatctcccagacctgtggctgcttctctttgctgagcctcacaaaatcttgtcctgtgcatggacagccaaggatccttgggaaatctcatgcagacttctaggtccttcctttgtgtagatttcttctctccagtacgttgacctgcttcagagtcctcatcattgctttcttccttttcagctcagcaatactgctgtgtattgtgtgggcttcatttgcctcagccatacctagaacacaacccaaggcagaaagctggagtggacctgaggctcatcacctgtttccttccacccaccatttaaaagcagcttatttgtgtgaaactttttgttgggttctgtgggggatacgtataggcaaatgacagggagcttataatttagccaaagagaaaatgtctatatgttctgtggaattcagagtattttcctcgacttccaaaattattttcctcgacttccaaaatttggggctactagctagttggtaggaaggaattccagatccatttttcttctagatttttttcagactccatgtttcaaaatctagatggaaggtaagaaggaagcaaggagggcatcacatacgagagagacttataccccaaagtggatcattagcacattatgagataatatggtattattctcagaggcctgccatataaaattccttctaatttattttttaatggtatgtgcctgaaagttttctgtctttcatgatcttgaaagcaaaataagaaccagagtagcttatgagagagttttcctgcttcagcccagaaaaatgttgcttctgtcctagaccctttgatctggttcttagtgccagccttcattcctctagatctgtttattgaatactggctctgttgcagagactttgctagaatctgagagataaaagactcaatgccttcaaaacacctacaatccagacacttaaataaatgcaataatatatggttaaggtcttggatagaggaccatcatagaaacacatagaacagacatttagtccatgctagggagagggaagatgtcaaggaatgcttcctggaggtggcgacatctaagctgagttttaaagtgggtgtaagagtgaaggaactgggaataggcaaaacataccttagagagctgcacctccaaagcatggaaggctagataatcttagaacttcaagtggggttcaatgtgcctgggacttggatttcaggcagagaccatagggcaagttggagaacaggtgggcagggtgagatgaagcagagacttttaataaccatcaaacaggcctgccatccaactgctatcagccattttccctttttgaattttatttttttaatctctagagcaatacatgtttatggtaggaaatgaaaaaaatatatagatgggtaaaatgaagtgaattataccacccacaatcctgctgtaaaacaggttttaacaagttataaatccctccagatcaaagtgctactaaactctacttgctattttataacctttttctgttcagagtattttagaaacgtttttacatgttaattgatattcttttgcattatcctgaataatggtatttctttagttatactatcatgtattaaaacattcatacatggtaaacatatttgaatattagacatttcaattgttttcaatgtttggctattaaaaatagtatttagatgaatgttcttggccatacagttaataacttcactgagtccttgtcaataactttattaaatcccaatcttaagacaacaagcctataagattaacataccaggaataattagaaagcattgcaagactatatgtaaccatctccctgttaatcatccttatttgttgcaacatcctaaatagcgaccttcccacactctgcctcataatatttaatctgtcaaatgtaccatccgcaaagggagtgaactggctcgtgaagaggtggtgaagctggttcaactcagtttaacagacaatgagggcctccgtgtgccagggagggagtgagggaactccacagggagctcattctggggagggatgcccctcattatctgcagtaaatgatattagagaagtatgtgtgagactcttggtgtccagaggaggggcatgcagcacagtatgggggtccatggggttgcagcgatttcttagagacggtgccatgcctgggatgaccaccaagttaggatgctgtaaagagtaatcaaataagtttcaacagggttttggcatgaggtgagcagttaatccaaatgatatctgaaatgctttctaatgctgcaagtgtattcctctgtaaaataatcaactacttaaaagacactctcacttgcattatgtcatttaatcctcacagtgtccctacgggacaatagatgtcattcccacttgtacagagcagtaagtgaggctcacaccggtcatagttagaggagtagggaatctaaacctaagtctcttctactccaaaccccaagttttatcagtatgtcacatcgctactgtgggctgaattccttagcaggggttgtttcctccacctgcaatattcttccttttggtttgttcatcctctagagagagaagggatacgcattcatggagatcctactgttgcaaactctgcattaggagttttacatgaattgtctcatttagtcctcacaacagtcctgtgaggcacaggaaagttagatttacctgcccaaattaaggaatgtggccaactcaagagtgacgaaggccaggtgcggtggctcatgcctgtaatctcagcactttgggaggctgaggtgggaggctgaggatcgcttgagcccaggagtttaagaccagccagggcaacacagcaagatttaatctctactagaaataaaaaagaaattagccaggtgcctgtagtcccagttacttgggaggttgaagtgggacgattgcttgagcctgggaggtagaggctgcagtgagccatgatcccatcacttcactccagtcagggtgacagagtgagacccagtcttaaaacaaaacaaaacaaaaaagagtgatggagcaggaactttatctgccatcagagaccatatatgtctttccttatggcccaggtcatttatcatgtccttgctaaacctcctcctctgagccttgttaaagtcctcaaggttagaagagtggtctataattataaaaaattccattgtatgacttcagctacctgcaaaactgaccgagattaatgcattctttgtttgctttcactctttcattccctgttcagcgcttattctacagaaaggtgcctggtagatttaggacatgactgttcataggcctcaaatgcggtcaaattaggaaagtcccctggtttttggtctcaagaggttaattgctgagtactagcctggactgctcaatggattttatgtttaactgttgtgtttatttgtttgtttgtttttgttttgtgagacatatctttctctgtcacctgggctggaggtcagtggtgtgaacatggctcaccgaagcctccatctcctgggctcaagtgatcctcctgcctcagccttcctagtagctgggactacaggcacacagcaccatgactggttaagttttggattttttggtagaaatggggtctcactctttgcgcaggctagttgtgaactcctggtatcaagggattctcccaatgtgctgggatttcggcctcccaaagtgctgggactgcaggcatgagccatcatgcccagcctctgtttaactgttaacatcatgaggtttcctttcaatgaggaagggaggcctggggaggtgtgatggggaagatggagaagggtaggagacatcataaaactgacagaagtgtggcacgattaagaccctggtttcttagaccacataagcaagtgccactattcttttgatcaacatttgattctctatttccttcttagcatatagatagctgcttcaggtcgtgaaaaaatacatttagtgaaatgaaacatagtagatatgttcaccaagaaactaaaaagaaaagttagccacaaactatcttatttcattgaaatgtttggctgaacccataagaatgttgatgaggccattcttggatgcctgtactgaaatgaaccacgagaggaatatttaggatatgttgaagaggctgtttggcttaatgaacaaaggagtttctgcaggcccagggagtggaatgaaaattggcatgatcattttggagaatatatggagtcaaacagagaatttgaatggagttttcaaagaggatatgttaggggaataaaggctgataaacaacacttgtatttgtaggaaaatagggagagtaaatcaaggaattcaaagagaaagagaaactcacttcaagtaggggagaaaaaacccctataattttcactcttccttgtaaataaaaaggaaacaaatgaaaataagatattagaagtcagtaagaatttatgggagtataaagttggttttatggatgcaaagcccttttcactgctgtacgaaactcctggctgcatgctaacaatggacaactgatttccttgcagctgtattttgctgttttttgctcttggcttggacctagcaccctgggtctgtgggaaaccagaactgtcccagagttctggagggtaggccaaggttagatgctggagtgggttctttaatttattgtactgattcttcttgggaagaaagaagattgcttgttagaattttagctacgagagatgactatgaaacagtaaattaactccaacgacctgagtcattttgaaaactcccagtctcaggataaaaaatataatcctatttagaaattcctggtgtgatcacagatgtagcattggttcttttcatgaaacccgtaaattaaaaagtacataatccaaagtcaattaaatagtaagctattataacaaattcttttatttcattagcttttcaaaatgtggataactacacactcaacccaaggaatctacatttttccactgactgctaaagaccaatggaaataactctagtccccgtagcacctcactgtggggtgacctacctttgaaataatgtattggttctagctgatttttatattgttagtcattaagttaggcttgatgagaaacagatataatctgatttggggattcaagtattatattgcatttctcctcacaactagagataaatttgccatggtttttctcttcataggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaaggtatgattgtgggtaaagttctcatttcctgccaaaatcttctggaaaaaaatctctaagattatctaacataaatgatgtgaatttatatttttaaatcctaatggagacattcattttggcaatagtagaatgcattcatttaacacctttctcatttggagtcttgaggaacttgaattaatttttaaaaacccatttgtaaatgagaaactgggttataatatttgtaattacttaactttcagttattaatctagatttttagattaaattgaacataaaacaaatcccaggatatctagctctctgcacatgtttttcagttcttgttattttggttgaataaaacactttaaagaaaaaggaatgtccatgttttctagagaaaatagtataaatagatcatgcttttaaagccttcatttatttatttattgcatcagacacaaagctgggtgtctaggatggaaagtggtacaagacatctttccagccctgtagaatatctattataaataaggaactattttttcaaggtgctcagaaatccaaaaaacatattagataggccaattttgagggcatttatttgtagagttatataggtttgattagagtctttcgtcaagaagaaaaatcattggcttaccaaacgagaagcattacactttatttatttaagtaggaaacgctcagctgctcttgaaccatgatgcaagtgcccagcgaagggtcatgttgctcttgtcccctcttccctttgcagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtaagtcagctgacaaaaccaatcagcagtctcaccaagccctatcactagtaagtagtgcttccttcctaggctgattgtcatggcacattgtccgttctttgagccaaaaacaattccttatgagtacactaagggcacaatttggaatgctgcacccttctctccaaaactcttccaatcttcatcttgtttaagttagatccaaagataaataaatttaaagcatatcaatatttaagatccgattaagacagtaaaaagataaaacactctcttttcatactgtggtttttgatcctttttaaggcagttgagttttttcatgaacaggatctaacacagaactccaaagcctctgagtttcagtggtgctgctgagactgaggcaggaacattaggcagagtcctccagaggcacaactgtgggctccacaaatgtgcagaaataccctaagaaagtaaaccctagatccaatgattcactggtcagaatgtcttttttagcaatagtcattgaaatgatacgaaatttcttcagaatgatcaaccaatatttattgagcatcttctcagtagtaagcccttaacattctttcagacttcctaaattttgaaggggcttgttttccagcatttgactggatactctagtaagcacttattggatgtctagtgtgtccgaagccttgtgttagttgctcgggtcgcttggttaaggggagtgcaggtagagggtatactgagatgagtaagggtaacctttgctttcaaaggagcaaaggagtctactgagcgaaaacaatgtatgcacaaatgatgcaatggagtgaagcgggcatggtggtaagtaacaagggcggggctgggggattgctgctgatagagtcccaagtgtgaaaatagccctcaagacagagacagagttcagtgtccatagacaagcagttggctttgacatgttgggttatggtagccaattaattggttctgcaaatcacagcttgaaaggaaacacttggaagaatgtgaaatgggttgctgttttcttgtaaatatccaattgaaatcttttatttataaggaaataaattaacaccatccttagtacattttttgctggttgggattattcttctttttcagaccacccagttcattttacaggcagtctcagacttaaaccctcgccttccatttaaaagatgactggctcacgcctgtaatcccagcactttgggaggccgaggcgggcggatcatgaggtcaggagatcaagaccatcctgaataacacggtgaaaccccgtctctactaaaaatacaaaaaaaaaaaaaaaaattatccgggtgtggtggcgggcacctgtagtcccagctactctggaggctggggcaggagaatggcatgaacccaggaggcggagcttgcagtgagccgagattgcgccactgcactccagcctgggtgacagagcaagagtccgtctcttaaaaaaaaaaatgactggatgtgtcatcttttatgccaggatatgtgagcccaggagaaaggcttctgagctccctcctgctcggtgtgcaattttctgccctgccccgactctctccttctctcccagcctcctgctatttgaaatctccttatcctaatttccctcctcagagtggattccactgtggggttcagagaggatctgaggtgggagaagtgaggctggtgaggaagaaggggaggagaaagggaagaagacctccgtagccttccttcctcctcctctttactggggttggggatagatcggatggtccctggtccttgttctatctcttgaccttctgcctgctccctgctgagcacggatctctgatagcagcctgagtctggcaggttcagtcctttgtatgcggcacaatctcccagccagcattgctgtgcagatcatgggaacgaatgcagaacaagagtgggggtgtcggagggagccctacttctcctgttctattcctcatcagggggctgtgcgctggctttgggaattggtaaatagtgagaaagtcttaagggtacatcctatttccttgagggagaagagaaaacgctggtcagaagcaataagtatagcagtgaatagcaagggagatgggagataattccttttcctactacactctagaagctattgttttagaatctgacctaaggtcagccactaattggccccagaggtctctctctcagatcacacggtccttttttcctcatcagcttggggaccccacccctcctcctggcagtctcctcctgtgcagaacccaacaaacacaaaattaagtcactctcaaacccacagcagatgagagcttctctggaagctccctggtggggaaaggctgcaattgctattttcttcttctggttttcacctcaggctttgtgttatattgacagtacccttctcaagctaactccctaactgacctgacgtagtcaaaataagttctttgtatgtcagttctgaggtgtgtgtgttttcacttacaaacagtactctacagctttaagacattatattaaagtcctgagaagtgatttttaaaccactgaacttcatcttttccctcctggctagtatttcagactttcagtgtttgaggcatgcatttcacctgaacaacttgaaaaataatatcctaagaagcacacaacctgactttaggctcattcacatggattgtcactttacttggacccactttctcggctgagaggtttgttttcccataaccacggatgctcatagttaatataaatattgaactcactatgtagtgaggacatagagcctctttaacattggtccctgttaggagaaagtttctcccataacatactaaatacatgttttaatagccgttccttctgaaaggtccaacttcactattttatttttttagtaaaatcttagttaacaaattaatggaggttaggtggaattttgccccaaaagtcctgtattttctttttttttttttctttttttttgacagagtcttgctctgtcgcccaggctggagtgcagtggcgtgatctcggctcactgcaagctccgcctcctaaggtcacgccattctcctgcctcagcctcctgagtagctggggctacaggtgcccgccaccgcacccggctaattttttgtatttttagtagagaccgggtttcactgtgttagccaggatggtctcaatctcctgacctcgggatccacccacctcggcctcccaaagtgctgggattacaggcgtgagccaccatgcccggcctgtcctgtattttcaagaaactttttttttcctccagaaatgataccctagtctttcatatttgttttcagatggactgaataaaagctgttgttttggaacaatcacggttaaaaaaaaaagttatgaatttagtcaactcagagctctataaaaataatccaaaaaattccttcaaactctgaacgcttcaaaagagcgtgcaaatattctgtccttcaaagctaaggaaacatgatttgtggggtgcatcacagtggaaaaatactctgacagcattcccacagcattaggggaagtgcatgtgtgggtgttctgcaagggacaattctccagaaaaggcaatttccctttgacatgctgtttttaatgacttttctttataaacacacttatctctccagagaaatagcagtgcatttgcaacaggcccgtaaaatgcaacaaaacctctgctatggtttctgacccctgcttttatacagagcatcagaccaaggaacctgttctaacaggattatttcagaggggaacacaggcttagggtgcagatcttccagctggatttttcactttgcattccctccacagcagacacatgaaggaatgattttgtgattttgattttataatttgcacacttttcctaaatactttttttaaatttttatttgggaggattttatagcatatgattgagaactataatcatcatcattgttacagaagaataatttagaaaaattttttaactacgttaaaaattccactatgggtggatgacaatattgttctttccttccacattctccctccttagactttcttttctttttttctattttttttttgagatgaagtctcgctctgtcactcaggctggagtgcagtgccatgatcctggctcactgcaacctctgcctcccgggttcaagtgattctcccgcctcagcttcctgagtagctgggattacaggtgtgcaccaccacacctggctactttttgtatttttagtagagatggggtttcaccatgttggtcaggctggtctcaaactcctgatctcatgatctgcccgccttggccccgcaaagtgccgggattacaggcgtgagccactgcgcctggcctctctctcggactttctaccatcagtcagattgaatttgttaaattctgtcactgaccctaaacccaacaaaaggcaagagttatgtttatttagcacttcctctacctatagcaaacctcaatttagagcgtaattttaagcacaatttaattataaatatcttttcattttcttacttaactcactcagttttttaaatcttcttttttgagacaagatcttgctctgtcactgaggccgatgtacagtgatgtgatcatgacttactgcagccttgacctcccaggcttaggtgatcctcatacctcagcctcccgagcaactaggactacaggcccgtgccaccatgccgggccaagacggggtttggacgtgttgccccagctggtctccaactcctggcctcaagtgaccctcccgcctcggcctctcaaagtgctgggattataggcatgagccaccgcacctggccaactcactcacattttaagttttttctttttttcatctagttttttttctttttaaatttgaaagcctcatgacattaatgatttcttacattaaaagaaaaacacccaaaaatactctgcttacataacaccgacaagtagtgtgcaagactcattagcatttgtcatctgaagtgaccaaatccagacttttgggggtcacattaaagaaacagttgaagagttagaactatgggtaaagcgagtgtgcatatcagaaagtggaatattgtcttcctcaggagctgacaatttatgaaaaatagttcacattctcagctagaaaggcttctatttttgctcatattcctggctagttttgctgaaataattgctttgaattacttcctcaggactgcccaggtgacgctaatgtttactctgcccttcacaggtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaaggtaaggagccctagctgcggctatctcctgaaggttatgtcaccagagggcatgacacttgattaaatctccaacatcaacacacactgccacccttggaatggagggctatccattttgtgcctcactgaaacagtccaagagatatctagcatttccccaaggataaaggagtgtagctaaaagtagaagaccagaaatccctagcccctactctggatctatgcaagcctagattcttgtcttccatcttggatggctccacagcagtcttaactgtttcatgtacataaagcagtacataaagatttaaccttgctgggcatggtggctcacacctgtaatcccagcattttggaaggccaaggcaggaggattgcttgagcctagaagtttgagaccagcctgggcaacatagtgagaccttgtctctactaaaaatcacaaaaattagctgggcacggtggcatatacgcctgcagattcagttacttgggaggagaggcgggaggattgcttgagcttgggaggtccagctgcagtgaatcatgatcacagcactgcaatctggcctgggtgacagagcaagacactatttcaaaaaaaaaaagaccaagcatggtggctcatgcctgtaatcccagcactttgggaggctgaggcaggtggatcatctgaggtcagaagttcaagaccagcctgaccaacatggtgaaaccccgtctctactgaaaatacgaaaattatccaggtgtagtgatgcacacctgtaatctcagctactcgggaggctgaggcagaagaatcacttgaactggggacgtggaggctgcagtgagccaagattgcaccattgcactccagcctgggtgacagagcaagactccatctcaaaaaaaaaaaaaaaaaaaaaaggatttaacccaagtatatcatagtagattgaattatgtaaaacacccatttaacaaccaggtccaggtttgttctctctgtgtagtaaatcaatcactgtgacacaggttttgcaaaagagaaaagatttatttgtaaggggaccaagcgagggggtgggagaataacttccaatcctgcctctctgaagacaaggcttaggaatatgtatgggttagggaatgggtggtctaaggcatggtgaagagtgattggcagggggggaaaatgaagtaacaggttagacacatgcacagaaaatggtggtgttagcatgatctgagggcagagttttgggccctctgacgtcaaaagaccacctctcaggcacttgtgcaggcccagtggaagggtcagtggtcttaactagtttgaactggacaggagctgccccaagttcttggaaaaacaactgaagtgaccattgccatggtaacctatgaatgtcatcagtaaagtagccagtgaaggttaagtttcagcatacaatgggacaaccttcagcttcatggaaaaaggaaaaaaaaaaaacacatacacacacgaaaagcaagtgaccaaaagcaagcaggacaggcagacctgatccaattaacccctgggtttcaaccctgctaaatgcagctcaatatttgtcttgataatttgcctatttggctttacataaaataaagccttttctgatgaaatctaattgagtctgaagttgtattaaatggtatcggaaacttcccagcaggaaggctacgtaaaagtggccgggcgtggtgactcacgcctgtaatcccagcactttgggaggctgaggcaggcagatcacaaggtcaagaaatcgagaccatcctggccaacatggcgaaatcccatctctactaaaaaaaaaaatacaaaaatttgccaggtgtggtggtgctcacctgtagtcccagctactcaggaggctgaggcaggagaatctgttgaacctgggaggcggaggttgcagtgagtcaagatggtgccattgcactccagcctgtgtgacagagcaagactccgtctcaaaaaaaaaaaaaagtgatgtgttgtgtgcaaaatacgtaataactactctcctatccttttgtttttccagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcatatgagtggttgctagctaatttttttgtaattaaaaaaacttgagttgactaagccacctaagatgtgatgggagcagtggagaaatgggtgtgactgcaagaggcctgacccacgcggctggaagatggtaggggtgggagggcgacccaggctaggccatgtgtggagcagagagaatttcagagatgagacagcgaaatacacaagagctgaaaaggacaaaacagaagccagagccgcgaagagaagcgacctctgagaaccatccagctaccttctaatgcccgcctcatgctgactctgagtcggtaaaacttcgcaggtagcttggggtgaacgaaaggagggcacctctaggatcagccccgggacactaggcggcggcgctggaggcggggacttcctggccctggtggggcgaagtgcactcattcctccaccgcgtctcagagcaccgcgttctttccactctagtcttcttctctgatgctttcctctcatgaattctggtgtacatataatacagaaaccatcctccagaatgcctacacctcttcttcctttgtgggccaattctacaggggcgctaagtggccgacttgtggttccccagtgtgtctgggctgtttcctacacacttgtattcgccctgcattcgcggcgtattcctttgatcccaggtggacttttatccgccgttcattttgccctgctttggaaggacggttttccagtttcattagtgacacgtcattttatctttgacttccacagtcaatacttagaatctgacttggtcctgttggctcatgcctgtaatccccacactttgggaggccaaggcaggaggatcaattgaggctagaaatttgagaccagcctgggcaacatagtgagacccgtctctacaaaaacttctaaaaattagccgggcgtggtgctgtgcacctgtagtcccagctactcgggaggttgaggtgggaggatcacttgaactcaggaggttgaggctgcagtgaactatgttcatgccattgcactccaacttgggcaacagaatgagacctgtctctgaaataataacaagaagactctattagagccttggaagttttccattaaattatttatgatagtgctgttcaacagatacaagcaagccatgtatttcattttaaattttctagtagtcatattaaaaaataaaaaggcatagaagagataaattttaataatatattttattctttccagtatatccaaaatattgtattttcaacttgtaattgatataaacattattgagatatttcacattttttttggtactaagtaattttggtactaagtaattagattggtctatagcatatttgtttaatatttaatattgagcaatgctgctggaaatttgcacttggaaaggaacatgttaatttggagcatgttggccatcctggatgggaggacctcggttctagaggggaaggcagaggccatgtcttgtctggtatattttttacagtgtttagcgcagtatctcttacatgatattgttcaacaaatgttgattaattgaatacatgacggaataaatgataagcagaattagctcactgccatcacctgtgcccagagactggtttaatagagatcacctgtcagccagcaatgacgatgtgttagatgccacacagctccatcctatatattcagaggaaggaatgataacctgtcttactaggtagagaggcagtaaaacttactgctgtcctaaattgttgcctccagacaaatcactaagtgaaaggttgtaactttttgtcttccttatccacatgtctttcaactagtcagtaatctttctctctcaggctgagttctttatctgtaaacaaaaacagtattttagaggaaccctttatgtcatctccaaatacttagtttcctagaatgtgtagcttttcccctcagacccattgcatttttccatttttataaccactaaatattgttggagttttgctggttgtaggacatttcctggaacttgttttttccatatctttgtggttaaacacccattgtctgatatcaaggagaaagaggtccagaaaacccacagggaaccttgagcaaagggtggaaatgccactaataatggtgacaggacacctacaatatggtgaaatcttgttttacatgatttctgcataccagaaaagacttggtgactactactcaagtcccccgacctctgcttttttttttttttttttttttttttttttttttttacccattgggttagagaagaaaacaatttcaacctacatattattgagataaaaaggcagagaaagaagaacaagaccaggctcaaaatgaccttacagttgggtagttttgggtaacgcaatccttggtgaacttcagtttcctcatctttgaaatgggagtgtctatcttagcacagtgctgaacataggaaatattcaataccttgggtatctaccccagacgttatttttttcctagactcatacaacttacccttaatgtgcatgtgatttcttgttaatcagatattttgagctcaataatgtaaaactagggactattacagtcaaaatgattcatcctgaagccttctagttattttatttgtgactttgaatatacattttcatagaatacccttggtaaaactaaatttagaaaaacgaagccccacatttacttaataataccaaattaccttcttggattcaaattttacaaatgttggattgatagaattctgaagataatttggcagcagatatttctgtatcaatatgttgaaccatctgctcttttgaaataatctaatgacacagacaaaacattaaaatgtgtatatttgttatttggttggtaaataattgaaggctcattaatttttatgagattcaaaaatctctggtagactttctgattttagtataatttttcaatatgtttactttatggtaaaatgaattaatgttaagtgacctaatttattttgtatacattatcttcaacggaaacattattccttaataaactgctggaatagactgacctttttttctgtttaaaatctcaattgatcagtttataaaattcaatttcctttcgatattataccagttgttgtctaattatggctgtgaccataaattttgcctaagacatttcagttggttttccatgtgaatcaaagctttggataatttatatccaacatgttagatggcaaattcaatagtgttccaaggtcacagtattgcatttaaggcatattggttttataaccatattttttcccctttaaattatgagaaccacgagtctctggtaagtagccccaaggcttcaaaatacaacatttcaatcaacagggggcagtagtggtaagccagagaggacacaacagagatataattagaggaagatggatgggtcagatagagatattttattagtaaaagacgagatgagattgaaccaacttttatcccaaattggtaccatgttaaatgtccttattttacctgtgcctgttatgggcctaacaatccaccaaaacaaacacaatgtggggttactacgaccatcatgttgacaggatgagctgcaagattccagcagtgttggcaacatggctgcactggttcactcagacagagaggaaggagctgagggaaaccagaaattaggtaatgggcttgcagccttggggagagccccagagtggagtagtacctctgaatctgcatgctctgggatgtgctggctaaatgcagaagaccaggccttttcccctcccagcccacgctttcgaaagtgcctttgggggaagatggcggcagcacccatggcttggtaagggatcactcccgactgattctgacaccctgttcatggagaaccacggggctttgtggaagggtgtagtcaagggcagatccagtgaatataagaaggcgagaaagaccagtgcacaggcaattgaacgagaaacaggaatgtcggaattcgagggcttaggagtgaagcatttccagcttgcatcaagaggactgatgaaggagaagccagccgttggaggggaagctcagggagtgttcctccaggatacgaggaaggtcgtgtacaaagaggctgaaaaggctggggatggttttagggcttgtgggagtgggcccagtggaggaagggaggaaagcgaaggatagaggagaactgtaggcaacgaattcaagtgtgtccagaaagtcagagcatgcctgagttgagaaagtggagtggaagggcaaggcagtaatatgccagcttccaggaactacaacagaggccctgggcccaggttttgggtggagcaggctcttatatttattccaaattggtaccagttaggtatctggtacctaaaccaggtagagagcccctattttctagttctacttgcaaatttgctttataacccagaggaagtcaccttaacccacggggcctcattgttttcttgtctataaaaagagggagttaatcaggaccagtgcttttctaccttggttacacatcagaatcgcctgggatttaaaaaattcctcagactaatgaagtcagtttttctggggggcagtggagctagctcccaggtgattgcaatgggaagctgaaattgagaaccagtgatctaatcagtgcgttgctgactttaacacacatatgagtcacctggggatcttagtcaaatgccaattctgattctagaggtctaggatgggcccaagggtttgcatttctaacagcctcccaggagtgcccatgatgctgctcttctgtggaccacagtttgagtagcaaggggctaagggccctctgggttgattgagggatataatttgttctaatagggataacaagagacagagagaaaagaactattagtctgttgttactgaaatggtatcatagaaagcgtcagaatgcaacaagtgccatggatggaaaacaggtactgatttaaggttgccacaatgaaaaccttaagacatgatgtcctaacaaacaaattatcactttaaatgcataatcattgtttgaaacagacgtgttttttaatattttaagttctgtggtacacatgcaggatgtgcacattcgttacataggtaaatgtgtgccatgttggtttgctgcacagatcagcccatcacctaggtattaagcccagcctccattagctattcttcctaatgctctccctccccttgccccacccctgacgggccccagtatgtgttgctccccccagtgtgtccatgtgttcttatcattcagcccgcacttagaagtgagaacatgcagtgttcggttttctgtgaaacagaccttttaggtgcagatgactacaatttaaaatttttaaaacagacttcaaagtctaaattaccatactttttaaaattggaaataactttaatataaaaaatcatgaaaaaaagtcaaaattatctgctttttttttcttatttttaacatgttggaagagtaactaaatcaagagccttatgctgaaaacatcctatatgctcaaacatcttctggtgatgtatattcaatatgagataacaaaaatgaaaaacagcagatctgtatgataatgcacataatattatgtgcatgtttactgataacagacaagatgtgaattaggagacaaatgttttaaatttattggaacttttttatcattaaaaatatattttaaaatatatgttgaatgaagacagaacgaagctagtcttgaagggagattgctgcgttgggcaggttgaagtctgaaaaaaataatagttctggaacaaactctctaagcctgtcatagacctgctctttctcacctggagacatcgtgagacctaggtttaattgccatttcttttctgtgtttggtgcatccatttgtaatgcacccaccttccagggctatttgaaagcttcagggtgttcatgtcatatgagaacatagtttatcaatgtaaaagcattgtccagatgtaaattattatcatctggctctctctcacactgaacccacttctgtgactgctaaagagatagagaaaaaagaagaatcaaatgctatcatgcttatgaagcaaactgtgggtttttaccacccacagttcttaccaacccaattgcaatagaattgcaaaatagactctccattgtctctgttgtctctctagcccttgacagtgaagcacaaatctacactgtgccaagccaggctcatcactcacatcacatgatggccactgcatctagttttcctcaacataaacctaaaagcctggatgacatcatcgtcaccattgtggtttttttttgtgaaagtgaagtggaaattgtacatgtttgatgcacatacaggtgacttgcgctgctatttttgaaggcctttaagaatactgtgttaaccaagaaatgcacacttttgttcaaaatattttggaatacgagtgacacgagtgttttatttctgcgtacagattacacagtatcatagcaaaactactttgtaaactgtgaattgtttagtgcattcatggtggatgtctcttgttggatgtctattcagccttcaaccagatagatctgaaaggcaatattcactatctttcctttctaattagctcttcctttctgtttccctaatttaccccaaacaacccttggagacattcaggtgtgaaattctatggattcttttcactgtggtatttgcagcatccacccttcatctgggtgcttgctgcaattgtactctttgcactctttgcacagacttttccaataatccctaactggttttctggtttgaaaaaaatgacaaaattatctgctttcttcttcttatttttaacatgttagaagagtaactgaatcaagagccttacggcaagcaccattttgattacgtcacttgcctcttccaggagcatctttgcatcctactcccagctggttggtatttgttctcagacctctcctctcatgtcccctggcctggtcatccccaaacctcactaaacagaattagcacctatcacctcctatgggacttgtgtgattgtttaatcccttccatttgattataaagtgctctgaggcaacgaccttatttgccttgttactccccaggacacatattaactgcctaataagcatttcttgtatgaataaatgcccagtgaaaaagggcatagaaatttattacaggtggttcgttaaaaggagtcaactgtttttccagttacctggggctcaattgaactctgttatctggcattttgccaatcacacttctctttaacaatattcatgatgataattggtgttcatggtgattaccccagggctgtacaaaatcctaaaaggccttctcagtcagttttaaaaaaagaccatatgaagatgtttgtttctcgttaaaagattcattatatgtattatcatagattatcaattttcaaggaattaaaacacaataaaaatcacagtaatatcacattgtacattaatcttcctttgatgattagttcattcaacaaataattagcacacacttaatatgtgcaagttaatagagttattaagcaggatatcctactccagtcaatttatatatattcaaaatgacgttttcatcgattgtgctagataatactggtttactgtaagtggcatacagtgttatatttaatcacttttttcaatatacattaagcaaaattatggctctttaaaatagttttttatagagcaattactaagaagtcacttatgaagaaaagttctataaatcaaatctggttcttggttatttcttcaaagatacctgagaacgggttggttttctgatctattggtacatttggtccctgctttggaccctgagtgatggcatggccacagctcttctccccatgtctgctcagtctggaacagagttgatctggcaatgcagattctgcctaggcactcgaagcagcggctctcagtcttggctgcgctttggaatcacttggggagttttaaaaaccactgatggcagggattccaatttaattggtctgagatgtagccctgaatctctttcatggctccagtctcactgcgtgagactgccagcctctcccaggtgaccctgactcctgggagcccagtaacacatcctctgtcctctgtcatcctgtagcccaggggaagtagtagctttctactgttgctactcttagtgtttccttatcatccccagttggcttctcagcaattccattacccaccgcataaccaattctgtgtataacattccctctgtggtttgaatcccaacgtggtttctcttttccttgttcagcttttcatcagatcttaatacagctggtgcagaaggcaacaaaaagtgggataagcactctgtgggacaaccttggacagccaggcctcgtcctgggtggggggcagaacaggcgtaggcccgtggagacaggggaatgggtaggacacaagtttcatgaccatttctagaggccactcctttagagccagagacacctgcagatattctataatacaaatctcatgggagaatttaacaaaatgttacaacttcatcatttttgatgatttgatttccttgtaacaggtcacacatatattttataaaatctgtcaggaagaaattaatttttaacatgcctttctgttggcatatagggttgatgaattaacctgaattaaccttttagtccatactagcaaagctgatgaaacttcaatgtgaatttctttttaaattctaattcctttttacagaaccttgctgttggcttgtacttcaaatccatgaccaaatattacataaggtaggtttgaaaagcctcatctcacttaaaacaaaacacttaaaaaatgcctgctctttgtcttgtgtgggtaagaggaggtggtctgttctgtattacttatctgtgttgtctcactggagccctgctgacaactgacaggtaaacaagaggaagcaattccagtaatcaaatgaaagctgcacgtatttgttggtgatatatacatggacacccagggccgcctttcacgtaagcacagggtagatcatacgcagacccagagccttttcttcacacacatacctaccgacttacctacacacacacacacacacacacacacacacacacaccctcagctgattctgcagcagccttcacccagctgtacttttgtaatggccttgctgaattgggttcccatttctgctgttttgcagaccccttcagaaagcaatagtaaacatcctctacatctaatagaaaagagttaagcaagtcaaagctagcatttttgtcttcttaggaacatcactgctgtaagctaagagattgaaccccatttatttagaactggagtgtaataaacacttatcaagccttatgtttgaagatattctattatcttcattttaaagacaagaaaacaggtatacagaagtgaataacatgctgttttagtctgtgctgctgtaacacaagaccacagacggagtaatttaagaacagaaatttatttctcacagtaatggaggctggaagtctaagatcaaggtggcagccttcttgctgtgtactcacatggtagaaggtagagggcaaagagagtgaattagcagaatgctatgtgaagcctcttttataaaggccttaatcccattaatgaggaagaagctctcatggcctaatcacctattaaaggccccacttcttcatactatcatattggcaacacctgaattttggaggggatacattcaaaccatagcttatgccaaaggcttgcagtaggaaaggtgaagtagaaataggatttaaataggca

SEQ ID NO: 1121 - DNA, 102150 bp, Homo sapiens
gcccatagctcactgatgggagggatagatgggcagtcacctaggagaaaggcctggaagtttctttctttctttctttctttcttttttttgaaaatagagtctctgttgcccaggctggagtgtggtggcatgatcttggctcagtgcagtctccgcctcccaggctcaagcgatccccccacctcagcctcctgagtagctgagactacaggtgcatgccatcacactcagctcactgttatatttttagtagagacggggatttgccatgttgcccaggctggcctcgaactcccgggctcaagcaatcctcctgcctcagcctcacaacatgctgagattacaggtgtgagccactgtgcccaaccagaagtttctttttttttttttcctgagatggagtcttgctctgttgcccagagctggagtgcagtggcgtgatctctgttcactgcaacctctgcctcccaggctcaagcaattctgcctcagcctcctgagtagctgggattacaggcacgtgccaccatgctgggctaattttctttttcttttccttttttttttttgagacggagttttgctcttgttgccctggctggagtacaaaggcacgatctcggctcactgccatctccacctcctgggttcaagtgattctcctgcttcagcctcccgagtaactgggattaccggtatgtgccaccatgcccagctaattttgtatttttagtagagatggggtttctccatattgattgggctggtctctaactcctgacctcagatgatctgcctgcctcggcctcccaaagtgctgggattacaggcgtgtaccaccgtgcctggcctaatttttgtatttttagtagacacagggtttcaccatgttggcaaggctggtcttgaactcctgatcttgtgatctgcccacctcagccccgtaaagtgctgggattaacaggcgtgagccaccgtgtccagcccagaagtttcttatagaactaaacatatgcctggccgggcatgatggctcacacctgtaatcccagcactatgggaggctgagatgggtggatcacgagggcaggagattgagactgtcctggctaacacagtgaaacccctgtctctactaaaaatacaaaaaattacctgtgcgtggttgcacgcacctgtagtcccagctactcaggagtactcaggaggctgaggcaggagaatcacttgaacctgggaggcggaggttgcagtgagctgagatcacaccactgcactccaccccgggcaacagagggagactccgtcttaaaaaaaaacaacaaaaaacaaaaaaacaaaaaaaaacaagcaaacaaacatatgcctacctgatgacccagcaatttcattcctaggttttgttgctgttgttgttgtttatcatctgaaatacagtcttgctctgttgcccaggctggaatgcagtaatgccatctcggctcactgcaacctccaccttttgggttcaaacgattctcatacctcagccccttgagtagctggggttacaggcatgtgccaccacgtccagctaattttttttgtagttttagtagggacagggttttgacatgttgtccaggctagtctcaaatgatctgccctccttggcctcccagaatgctgggactacaggcatgaggcactgtacgtggccttcctaggtatttacctaagagaaatgaaaatacatgttcaccaacaggcttgtataagaaagctgagattacctttactcgtatcaaccaaaatggaagcatcccagcttctatcagcaggagaatggcaaacaaatgtgggacaatgtggatgaatgtcaaaaacaggaggtgagtgaaagacgctagacacagaagtagatgctatgtgacttcatgtaaaatgctagaacaggcaaaataggtctacatttaaaaaataaaaactggggtggggcgcgatggctcatgcctgtaatcccagcactttgggaggtgagcagatcacctgagatcaggagttcgagatcagcctggccaaaatggtgaaaccccatctctactaaaattagtagggcgtggtagtgcgtgcctgtaatcccagctacttgggaggctaaggcaggagaactgcttgaacccgggaggcggaggttgcagtggactgagattgcgccatcgtactctagcctgggtgacagagtgagactccatctaaaaaaacaaaaaaccaaaaaaaaaaagaaaaaacagcccaggcatggtagctcacgcctgtaatcccagcactttgggaggctgaggcaggaggattgcttgaggccaggagttcaagaccagcctgggcaacatagtgagacctcctcgctacaaaataaataaaaaataaataaactgccgggcgtggtggctcatgcctgtaatcctagcactttgggaggctgacgtgggcggatcacttgaggtcaggagttcaaaaccagcctggccaacatggtgaaacctcatctctactaaaaatacaaaaaaataagtcaggcgtggtggtgggcgcctataatcccagctacttgggaggctgaggcaggagaattgcttgaacctgggaggtggaggttgcagtgagccgagattgtgccactgcactccagcctgggcaacaaagtgagagtctatctcaaaaacaaacaaacaaacaaacaaacaaacccaagagtggttgcctggggtcagatgggaaggggcatgaggcaaccctgcaatgtgatggaaacgttccatttcctggtagggacttcagttacacaggtgaaaggtttctcacaactcatcatatcattatacttacatgtgtcaaaacccatagaatatccagtactgtgtacaatacagacagtgagcccttatgtaaactctagacttagttaatatatgaatatcggtccattggttgtaacgaatgtaccacactagtgcaggatgttagtggtaggggaactgggtaccggacatacatggcagttctttgtacttttcgctcaaattttctgtgagcctaaaactgctttaacgaaacacaattaaaaatgaaacaaaaccggccgggcacggtggctcatgcctgtaatctcagcactttgggaggccgaggcaggtggatcatttgaggacagaagtttgagaccagcctggccaacatggtgaaaccctaaaaatacaaaaattagctgggcggtagtggcgtgtgcctgtaatcccagttacttggaaggctgagacatgagaattgcttgagcctgggaggtggaggttgcagtgagctgagattgcaccactgcactccagtctgggcagccgagtgagaccctgtctcaaaacaaaacaaaacaaaaccactgtttagtctctgaaataaaggtcaatatcatataaagcaaaactcttcaaatgctgtccttaagatttatgcattttaccacgtgtaaatgtttcctaaaacaaacaagcaaagaatatcggattccattaatgctatgaatgctgaagcgtctagaggtggtgtgtactgatctttgcaatttactttgaaatgcattaaaaatgtattgatagatagaagaatggggagaagagatgtgataaaggaaataaggccatatatatatatatatatatatatatttttttttttttttttttttttttttttttttttgtagacggggtcttgttctgttgcccaggctggagtgcagtggtgtgatctcggctccctgcaacctctgtctcccaggttcaagcaattctcctgcctcagcctcccaagtagctgggactacaggtgcgccatcacacccagcgaattatttgtacttttagtagagatggggtttcgccatgttggccaggctggtcttgaactcctggcctcaagtgatccacctgcctcggcctcccaaactgctgggattacaggcacaagccactgcgcccagcccaggcaaaatgttaatggtagaatcctggtggtgggtatgtgaacgttcactggacagtttgttatttttttttgagacacacggtcgtgctctgtggtccaggcaagagtgcagtggcatgatcatagttcactgtaaccttgaacttctgggctcaagggagcctcccatctcagcttccagagtagctgagactacaggcgtacaccaccaggcgtggttaatttttttctttaaattttgtgtacagttggtgtctcactatgttgcccaggttggtcttgaactcctggcctcaagcaatcctcttcccttggcctcccaaagtactgggattacaggtgtaagccaatgcacccagccttcactgtacaggtttttcaactcttctgtaaatgtattttcataataaaatgttgggagaaaatctccaatatggaatctgttttccatggcaaatccctaatcgcaggtaccacagccccactgtttccctctatcagtgttcttcaaaccattttgaaattatctggaggacataggtgtcttcccttctcccagtttctggcataaccttttggataactatataaaacacgtccagtctccatgccacatactgtgggaagtccagcactttcctcaagatatctcatgattccttgagaggaagtgaagtggggtaaatattatcctggtcacttggagtgctgtcgccctggcacctggctcaagtccagagacacaggtcgggctcagtcggcataggacgaactcagtgtacccagccaggctgagcttggtcggtgatgtcttcctccctgctgccatttgagcctcagtcctcatctgcagaaattctggtcccaggggaccgcccagacggcttccctcgctgcctggcgcctccagctgtcttaaagcttcggccggcactggcgcagcctccctccagctgtaccaggaaacaggacacaaatgctgagggtctgggtcaccaggccatgtgaggaaaccagctaccacaaccagggcttgctgagacaggatcccaggtgtgggggacagtgctgctgagccgtcacggtggcctgctggccctgggagaacccagggctctgttctctcaggggcccctgggctgtcctgcgggagtggagtgggtgtgaaggacagaaagacagactgaggggtggcttcctgccagggtgtccaccacacctccttccgatcttgagcgcgcctttccctgcagttctgaaggaagtggtccctggagctctgtgctcagcggccccagctctttaaagaaaaaacaccctggccgggtgtggtggctcacgcctgtaatcccagcactttgggaggccgaggtgggtggatcacgaggtcaggagttcaagaccagcctggctaagatggtgaaacctcgtctctattaaaaatacaaaaattagccaggcatggtggcaggcacctgtaatcccagctactcgggaggctgaggcaggagaattgcttgaactctgcagggcggaggttgcagtgagccgagattgcaccactgcactccagcctgggcaacagagtgagactccgtttcaataaaaaaaaaaaaaaaagaaagaaaggaaaaaacaccctggaaatcagaggaattgcatttttagaattgaagcctgagaccagagagggtgtgacctgtggctgagagcaacgcgggccagatcccagattagccaggtccggatgccaggcagcccctccctggaccagcacgcccgtccggtgactcgtccctaagcctcgtgctgacaaggagggtgagcaggctgcggggaggggtcagagctgtgtggagtcaaccagcctgctcttcccatggcctgtgcttcccccgccccagcccctccagccaggtcacccctcccagccagaggatgggcacctgagtacagctgccagccagggacaggcttcaggctgcctccaccctgcccttcttcttctctccctctttcctccccaccctcttcctccctcctttcttcaggcattcacagacagggctgcccacaaggctgcagatcctcaagaaccaaagggaaattcctgcctgcttgtctcttccaaaaagccgctcgcaaagacagacatctacaaacatctacagtaaaaagatgaatagtgtaaaaaataacaacttcctgttccattctccacttgagacaaacgggactgcatggtttgttgcatgtgggcactgcacttccttcctgtggtccccccacctgccacgggagtgtccctctccctcatctcctggatccccgagggacgcagggctcccctctgcacttcttcaggcctctcatcttagttcctgctggccgtcagctcacttgtccagggcacccggttctgttgcccagcctggcacctgatactagcagttctcaatgaatactgagaatgacgtgaatatgaaaaattgtaggctctatgcttgcctccgatgtcccaggggcctggcaaatggcagaaggtgggtagttccccccctccttttttttttttgagacagggtctcactctgttgctcaggctggagtgcagtgacacagtcatagctcactacagccttgacctcctgggctcaagtgatccttccacctcagttcagccttctgagtagctgagactataagggtgcatcaccatgcctggataattaaaaaaaattttttttgtagagtcagggtcttactatgttgcccaggttgtccatgccttttaaccccaggcagtaccttaggagcccaacctaggagctgctaacggctccaaggactgcaggatctcctgaggatcatggcagaagtcagggacttaagggacccgaagagtctgctccccttgaaaagggagcaagagcagcatctctgtgcaaaggaagcctggagaagcagcagcccagccctcctctcatgcttgcttgagggttgcccttgcagctgcgtcaggtgctgagcaggctgtggggaagaggacaccagcccctcctgttctctgcttacaggctgaggagaaggcagctgtgtaagctgaccacatactacacattggggaagggacaggtgggtggtcagaggaggccttgacccaggcaggtgctgtcagaagcggcttcccccaggaagtgacgatcatttgaatcctggagcactggggggaatgggggagggagaacattctaggcacagtgaatactatgtacaggggcatggctatgtgagagaccagggtgaactcaggaacagataagggtgttcagagcacaggagaccaggaggttggcagcaccaggccctgggggccttgttgaccaacccaaggaatttgaagttgctgcagacagtgatgcgtggcagcactggtggatgaattggccttttctcctttcccccaacactccagggtcattcctgcctgaggactcctgccctcagagctctcctggggcttttatttattttgttttgagacagaatgtggctctgttgcccaggcttgagtgcagtggtgtgatcttggctcactgcaacctctgcctcccaggttcaagcgattctcctgcctcagcctcccgagtagctgggactacagacgtgcgccaccacgcctggctaatttgttgtattttagcagagatgtggtttcactgtgttgcccaggttggtcttgaactcctgaaggcaatccacctgcctcggcctcctgaagtgttgggattacaggcgtgagccacctcgccggcctctcctggggctttgaacgcctgcctccctcctctcatttgggtctcaggtcacccgcctgcctctgagttcacccctgaccacctagactctgcctgttccatcatctttgttccatctctgcctgttccatcatctcggcaagatccggtatttccttatgtgtttatggcctacttctcctcactggaatgtaaactcttagaaagcagagatcttatctatcttgttcacctatgcatccttggctgttatgaggatcatgggagagcaacaaatatttattgaggaaataaaagaacaaggtaataaagccagaacaaagtggtggcagtggagatggattcaagaaatactgagaggccgggcatggtggctcacacctgtaatctcagcactttgggaggccagctgggaggatcacttgtggccaggagttcgagatcagtctgggcaacatagcaagatctcctctctgcaaaaaatttaaaaaacattagctgggagtggtggtgcacacctgtagtccctagctacttgggaggctgaggcaagaggatctcttgagcccaggagttcgaggttacggtgagctgattgccactgccctccagtcagggtgacaaagataccctaactcaaagaaatattgaggaagtagaatcttttccacctgttgtagtagggcgtaagggagcggtgcaggcatcccaggtttctggctagggttgtgggtgagcagaggggacagttactgggcgcagcggcacagaaagaatgagcagtcgatgcttggcggtgcccagcccagtggctgaacttagtgacatccaagctgcagtctggctgaaatcactaacctgaaagtggtatggagaaagtttgtttgaccctgactcagtgcctctccccgggccaaccctaccgtgttacctaggagctccccctttgtctttataaatgagataaaagtaaccagacctccctggaaaaaccgaggagcacttgcttctctggtgactgcggggcctaactgcagggttcacaaagggctgctggtgctgggtgataacatcggaaaggaacagcagttcacaagatggggctgggggactggcccaggaacccctccaggttaaatgatgcctccgggccccgcacttgggacgtctgcaggcactgggagggtttttcccaagccgctggcagcagcgagcggagcctcgcccattgaatcagcatgccctcccggctggctgctgagtcaggcctgcggagccggcgaagccgcaggacttgacccaggcgcgctccgctgcccttcaggccgggctggaggtcgaggccctgcagccagggagatgcgccggtggctgcgtggggacagaggggggttgtctcccaccctcacagtctacaccccggcccttcccctttgcccgtctgaggcgcagtttgtgtcgagggggagcgcctggaaagtttcctcgtacagatacgagggtccaaaagccccgaggagagggaataatgagaaggggagggcgcagggttagaggtcagggtctcgaccaaaggctgtcggttttcctggaggagggagaaaggcctggccgggatcatctgattccggggcctcccgaaggcctcctagctgggttttggggggaccgaaacgagcgcatgaagctcgcgggcctgggagtggggtggggcgggagcccagtggtggcggctgcggccgggcctgcaccgtccccggccgcattctggtagggcccacagtccggctggaagggaagctgccgaagcgctcggtcatcgcggctgcggagtcggagaggccagggcctggccgcccaccccgcgagccgcgccctgccccgagcgccccacccccgtccgcgttacaaccgggaggcccgctgggtcctgcaccgtcaccctcctccctgtgaccgcccacctgatacccaaacaactttctcgcccctccagtccccagctcgccgagcgcttgcggggagccacccagcctcagtttccccagccccgggcggggcgaggggcgatgacgtcatgccggcgcgcggcattgtggggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctccaactaaacttgaagcagcctccgtcctggaatgctttttccatgtaaaattgggtgtacccttttccttaagaaaattaaaataaagcgtaaaagtagtgaaattaatgcgtgatggagtggatggttttataacttaacatttgtaggtcatttctaggtatatttgtattagaattgttgctgcctgttactgttttattatttaaatgaattaagaatttacatattaagcgtttgaaaaggaatacttacaaaaatgatgttttttaaaaatgtgagaacaaaaaatttgagatatactatttcaggtgttctgtaaaagggcagttagagctttgattctttgcattagttaaatcccaaggcctttttttttggtacggcatgactaagccattgatcagaatcagctcggaatacattgcactagtttagtgaaagacactttagaaaactggaagaacctcctgaagttatattacagacatggccttgcttctttcagggattgtcagcaagcctgttatggtgagaaatttgacctattgctctgtttcctaaatatttgtaggaatacaatgatactaagtatgaagtatatttcaacttgtatggaattctgtgtgggagggtaggcactctaaagagccagtgtctctccaagtcatcaaagaatgcagcatcatgttgcagttgagcctggcagccctgtctggcactgagtgctgtggaggacccaggtggtaacctctaaccctactgcagccttggcattgtcttagagaaaagcatccagacatgcacaggactctggacagcgtttatctccagcaaggggggagggaatgacactggggagaggcacacagtatcttcagtatttcatagcaaataactgcagtcgtttaaacttacacattttttttttttttgagatggagtctcgctctgtcgcccgggctggagtgtagtggcgcgatctcggctcactgcaagctccgcctcccgggttcacgccattctcctgcctcaacctactgagtagctgggaccacaggcgcccgccaccacgcccggttaattttttgtatttttagtagagatggggtttcaacatgttagccaggttggtcttgatctcctgacctcgtgatccgcccacctcggcctcccaaagtgctgggattacaggcgtgagccaccgcacctggcccaaatttatacatttttaaaatttatacattcttaggcatgtttctcaatgttggaaaaaagtcaatgtgtaactttctgtatagggccataaattatcttaaaacatacttgtataaaaagaaacctaggatagaaaaatcaaaagttgagtgaaatgtatgattagtatcacctgaaaacattctttgtagataagtggaatgttagaaaccagtattttatttttatttatttagagatgagtctcactgtgtggctcaggctagagtgcagtggtgtgatccccgctcactgcaacctccgcctcccaggttccagtgattctcctgcctcagcctccctagtagctgggattacaggtgcccactaccacaccaggctgattttttgtatttttagtagagacggggcttcaccatgttggccaggctggtctcaaactgctgacctcaggcgatccacccgcctcagcctcccaaagtgctagggttacaggtgtgagccattgcacctgggctgaaaccagtattttatgtagcaaagaaatgatcagtaatatactcaagacgagagtatttgggaagatttaagtgtcaaatttcagggcatagaataaaagtgacaagcacattaagattgcaaatactggtcttaaatgtctgttgggaaccaactgaatggcaggtactgtgctgagtagtcagcgataccttgataaaagagccactgttggccgggcgtggtcatgcctgtaatcttaactctttgggaggctgaggctgcagatcgcccctagctctttgggaggccgaggcaggtggatcacctgaggtcaggagtttaagaccagcctggccaacatggtgaaaccccgtccctaccaaaaatacaaaaattagccaggtgtggtggtgcacacctgtaattccagctactcatgaggctgaggaaggagaatcgcttgaaccgggaagtggaggttgtagtgagccgagatcacgtcactgcagtccagccagactccgtctcaaaacaaacaaaaagagccgctgtcagccgtgcagtggctcactcctgtaatcccagcactttgggaggccaagatggaccgatcacctgaggtcaggagtttgagacccgcctggacaacatggtgaaaccctgtctctactaaaaatacaaaaaaaaccaaaaccgggtgtggtggcgggtgcctctaatcgcagctactcagaaggctgaggctggagaatcgcttgaactggggaggcagaggttgcagtgagccgagatcacgccattgcactccagcctgggcaacaagagcaaaactctgcctcaaaaaaaataaaaccaaaaaacaaaaaaactctgtcctctaggagctcacaggctggcatgggcaggtaccacagaccaggttaaaggctgtggagtgcactgaggaggcgattcttcacaaaagaaaagtaccaatcagccagtgtcagggggtcaggggtgggattgggattggggttcctgcttggaggaaataaatcctgaggttgtgctgctgtaaaggggcatgttgggaaggggacatgggagtgagtgtggaaagacgaggttaggaaaggccttgaatgacttcttagaagtctgctttcattctgaggtttacaaaggagggttggaagattttttttttttttgagatggagtcttgctctgtcacccaggctggaacgcagtggcacgacctctgctcactgcagcctctacctcccaggttcaagtgattctcctgcctcagcctcccgagtagctgggactacaggtgcgtgccaccacatccggctaattttttgtatttttagtagagtcggggtttcaccacgttagccaggatggtctccatctcctgacctcgtgatccgcccgccttggcctctcaaagtgctgggattacaggcgtgagccaccgcgcctggccggagggttggaagattctgaggagccagttgccactttagaaagagcataggcagtggtggggcaggtgctgtgaactgggatgaggttaattaggaagccattaaccccaactcggcaagcctcaggattagggcagtgacagaaggaacagagaagctaggtgggggcaggggctgggctgtaagggttatagtggagctgatttggggctgactggattggggtaaatgaggagctgcagggaggactccccagaatgatcctgtgaaaacctgagtcactcctctgttaaagcttttgtcagtgtcctctgagcaccccaccctgtctcttttcatcttcctgctctggccctactcaagcacttccaggtgcatctggagttctgaaccaaacccattcttgtagtgattagcatttcttcacttccccacatactccttagcctctgccctgatttttctccttagcacacctcactatcttaaatgctgtattattattattttttttttattattactttttgagacggagtctcgctctgtcacccaggatggagtgcagtggcatgatctcagctcactgcatcctctgcctcccgggttcaagccattctcctgcctcagcctcccaagtagttgggactacaggcatgtgccaccacacctagctaatttttgtatttttagtagagacaggatttcaccatgttggccaggctggtctcgaactcttgaccttaagtgatccacctgcctcagcctcccaaagtgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaatctgaagtgcttgtggggcagccaagtggactagtgggcagttagagatacatctttggagctcaagacagaggctgaggctggaggtaaagattccagagactgcatcatatcgttgagccagtcgggtgtgatgtccatctggtagagatggggagtgggtctaagaggagagggtcctgggaaaccaagagaagaggagggaggagatcagtagcaaattggctaagaagtcagtgatgggttggactgagaagtctctatggattttgcttctaggaggttactaatgacctttaacttttttttttttaaatatagtttatgtagagacgggggtctcactgtgtttcccaggctggtctcgaattcctgggctcaagccatctgcctgccgtggcctcccaaagtgtcgggattacaggtttgagccactgcacccggcctgttgcctgtttcctgagaatattacctcttaaggatggaggctatttcgagatgatcttcattcgttctcccaaggcatcctttgtggcgttgtactctgtagcctcctagttagtatactcatggatcagaaatgaattatgatttttttttagttttaactaatttttggaggcagatgaaagcagtttgcatatatgctttttgaatttgaaaagtgctatctgaacttaaagcaacggatatggagcaaacatgttaagctgagttacgtgcatacgtgaactgagttacttccttggttctaaaatatctgttaccttcatttaaaccatagattgttccctgacttcagttgcataacataaatttatgttcaggcttctctgaagttcactatgctgctactaaaactgatcagagtgatgtttgcactgttccagagaaaataggtactgtaaaccctgcggatgtcatatgtgtctgtagtttcagttactccgaaggctgaggtgggagaatcagttgagcccaggagttcaaactagcttgggcaatatagtgagaccttgtttcttaaaaaaataaaaggctgtgcttggtggctaatgtctgtaatcccagcactttgggaggctgaggagggcggatcacctgaggtcaggagtttgagaccagcctggccaacatgggtgaaaccttgtctctactaaaaatataaaattagccgcgtgtggtagtatgcttctgtagtcccgggtatttgggaagctgaggtaggagaatcacttgaacccgggaggcggaggttgcagtgagccagatcgagccacggcactccagcctgggcgacagagtgagactcccatctcaaaaagaaaaaaaaaaagtaaaataggtactgttactgagattctactgttgaggaatttgagggtgagagaggggaagtttcagaaaccaaagttacacagctgtgaagtcaagattctaactcagtttttttgcttcgcggtataagctttgaatcaccttgcagtacttaaagctgcagcttcaagtgaatcatgataatgctgtttaatcctatcattactttttcttggggaaacctcgcgccacttcaatttttttcaaagatgtaccattttaaccatttaaaagttcacaattcagtagtgttaaggatatgcacatcgttgttccacatttctggaactctttcatctggcagcgctgagactgtagcccccaaatactgatatctcctcctccctcgccctcccccggtaaccatcttttctactttgtttctatgattttgactactttcaatactttattttttattttttttgagatggagtttcactcttgttgcccaggctggagtgcagtggcacgatctcagctcactgcaacctctgcctcccgagttcaaacaattctcctgctttaatttcctgagtatctgggattacagtcatgggccaccatgccgggctaattttgtatttttagtagagatgggtttctccatgttggtcaggctggtcttgaactcctgacctcaggtgatcaccccccatcggcctcccaaagtgttgggattacaggcgtgagccaccgtgcctggccttgcctgtctttttcatctgagccattctagcggggtatagtggcatcttgttagttttaatgtgcatttcactgatgactcataatggtgagcgcttacatgcttgtcggtctttgtatgcctggatttgtaaagtgtctgttcaagacttttgcccatttaaaaaattggattgtttgtatttttaagttccttacatatttatttatttatttatttttgagatggagtctcctctgttgcccaggcttgagtgcagtggcgcgatctcggctcactgcaagctctgcctcccgggttcacgccattcccctgcctcagcctctggagtagctgggactacaggcgcctgccaccacgcccagctaatttttttttttgttgtatttttattagatatgggtttcaccatgttagccaggatggtctcgatctcctgacctcgtgatccgcccgtcttggcctcccaaagtgctggtattaacaggcgtgagccaccacgcccagcagttccttacatgttttttttttttcagatggagtcttgctcttgctctattgcccaggctgacgtattttttatacaagccgtttgccagatatatatgtgtcgcaaatattttttcctaatctatggcttaactttattttttggtagtgccttttaataaatcaatacttttaatttttcttaaccatgctctggcaagttttattaaagaaattttcggctgggcgcggtggctcacacctataatcccagcactttcggaggccgaggcgggtggatcatgaagtcaggagtttgagactaccctggccagtatggtgaaaccccgtctctactaaaattacaaaaattcgccaggcgtggtggtgtgcacctgtagtcccagctacttgggaggctgaggcagaagaatcgcttgatcccgggaggcagaggttgcagtgagtcgagattgcgacactgcattccagcctgggcaacagagtgagactctgtttcaaaaaaaaaaaagaaattttcgcagggtttatttttatcttttattttttgttgttgcctaagcaacatccgctttccttaattctgaaagcatatctataaataagtcacccaaaggccaaatagatgcatttgttttgtctggttgttaatgttttctttttaaaaaaatatttatgtatttatttaatttttgagacaggatcttgctctgttgcctaggttggagtgcagtgtcacagtcgtggctcagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctcttttagaaaattgaaatgtaagtcacatcacatcaaatgccccattttaaagcgtgcagtgcagtgatttttaatgtattctctgttttgtgcaactaccatctatctaattccacacattccttttccctttttagtgcttggtgttttttttttttcttaactttcttcatcactgtaagctttccccacctggctgaatttcacatgataaaaccaggggaggtaaagtgaccaaagatgatgccctttgcttctctggcctttgctttcatttcattaatttttttttttttttttttttttgagtcagagtctcgctctgtcacccaggctggagtctgggtgtatatgtatgaacacagtggggtgtgtgggtgtgtgtgaacatagtggtgtgtatgtatgaacacagtgggggtgtgtgtgcgtgagcacagtggtgtgtgtatgtatgaacataggggtgtgtgtgagcacagtggtgcatatgtatgaacatagggtgtatgtgtgtgagcacaagggtgtgtgtgtgtgtgtgcgtgcatgcagagtggtagggttcctgaagcagagggacacttggggcaaagagaccttggattgtgttcttcttgttggtagaataagcttaaatcacttcatgtatcccagtttcctcagctgtaaatgggaattataatgataggtcatcaaactacctgcagactttttttgttgttatttcgataaaatattacacatttgaaaatgctcccaaaactaacatattggacagatgcgaattcttctttccttttttttgagatggagtcttgctctgttgtccaggctggagtacagtggcatgatcttggctcattgcagcctcagcctcccaagtagctggaactacaggcatgtgccaccacgcctagctaatttttatatttttagtagagatggggtttcaccatgttggccaggctggtcttgaactcctgacctcaagtgatccgcctgcctcagcctcccaaagtgttgggattacaggtgtgagccaccacgcctggctctttcttgtcttttacttatttatttttttgtgacagggtttcgctgtgtcacctaggctggagtatagtggtacagccaaagcttactgtagccttgagctcccaggctcaaacaatcctcccaccttagcctcctgagtagctgggaccacaggcgtgtgccaccacacccaactaatttttatttttgtagagacagggtctcactgtattccccaggctggtcttgaactcctgggctcaagcagtgctcctgtcttggcctcccaaagtgctgggattactggtatgagccaccacacccggcccagatgtgaattctttatttttattttattatttttgagacagggtctcaactctgtcacccaggctagagcacaatggtgcaatcatgtttcactgcagccttgatttcctggactccagtgatacacctcagcctcctgagtagctgggaccacaggtgcatgtcaccacacccagctaattttggtatttttttttaggatggggttttgccatgtttccctgtctggctttgaaatcctgagctcaagagatccacccgccttggcctcccaaagtgctgggattacaggcgtgagccactgagtcaggctgtgaattctttcttttattttctttatttttgagacagagtttcgctctgttgtggagtgcagtggcacgatcttggctcactgcaaactccactttccaggttcatgcgattctactgcctcaccctcccgagtagctgggattacaggtgtgcaccactatgcctggctaattttgtatttttaatagagacagggtttcaccatgttgaccaggctggtctcgatctcctgacttcaggtgatcgacccaccttggcctcccaaaattctgggattacaggcatgagccactgcccctggcctgtgaattcttttttttttgagacagagtctcgcgctgtcgcccaggctggagtgcagtggcgcgatctctgctcactgcaagcgtcacctcccgggttcacgccattctcctgcctcagcctcctgagtagctgggaccacaggcgcccgccaccacgcctggctaattttttgtatttttggtagagatggggtttcaccgtgttaaccaggatggtctcgatctcctgaccttgtgatctgcccgcctcggcctcccaaagtgctgggattacaggcgtgagccaccgcgcccggccctgtgaattcttaatatacatattgtatgtatacttttttggttttgtttttatcaagttatatatgtattttgtatttatgtgtagatttgaaaataaacttttaattttagaatagttacagatttacagaaaagttgcaaagatagtacagagagttcccacatactttgcatccaatttcccctaatgttaatatcctacattactgtgatacatttgtgacaaccaaggaaccaacattggtaccttactattattattactattattttttttttcttttgagacaaagttttgctaggtcacccaggctggagtgcagtggctccatggctcactgcaacctctgccttctgggttccagcaattctcctgcctcagcctccctagtagctggaattacaggcatgcgctactatgcctggctaatttttgtacttttagtagagatggggttttgccatgttggccatgctggtctcgaactcctgcccttaagtgatccacctgcctcggcctcccagtgttgggatcacaggtgtgagtcactgtgcccagcctggtacattattattaactgaactccactttatttggtatcactggtttttcccttgtccttgttgtacctcaggatcccatccaagataccatatcacatttagtcatcatgcctcctgctctgtggctgttttcttagactttccttgcattagaggactgtcttagcttgcgaggctgtaacaaagtaccacaggctagtgactcacgaacaacacaagccacagtcctggaggctggaagtctgggatcagggtgccagcatggtcagattctggtgcagaccctctttctggttgcatgctaccgacttctagatgtattctcacatggtgaaaagagtgtgagagagttccctttttaaaaaaaatttaataataattatttttttgagacagagtctgtctctgttgcccaagctggagtgcagtggcacaatcttggctcactgcagcctccgcctcctgggtgcacttcatcctcccacctccacctcagcctcccaggctcaattcatcctcccaagtagctgggactacaggtgcacactacaacacccagataatttttgtattttttgtagagatggggttttaccatgttgcccagactggtcttgaacacctgagctcaagctatctgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtctcgaactcctgatttcaggtgattcacccacctcggcctcccagagtgctgggattacaggcatgagccactgctcagcccctgggttcccttttttaaaggcactaatcccaccgtgaggggtcccctcatggcctaatcacctcccaaaggccccacctcctaaaagcattactctaggcattagaattttaacatgtgaattggggtggggggcacacattgattccattgcaataaccttgatagttttgagacatatgggcaaggtattttgtacaatgtccttaaatttgggtttgtcttgatatttttcccatggttaagtcagggttatgagtttttaggagaaagactactggctcccagttttggattctgattccattgtaccaaaacaaatcagaactctttggagtaatgggtgattctagggctggggcagggaaaatataagatgagcctgaagcttcttctagtgtttgaatgtaaggatatgctaaaaaacaaagggatgggaacatgaagaagggacacaggaaccaactgaaagagctcccattgacaaaagctggaacaacttgaacaataaaataaataatgtagttttttggttttttggttttttttttttttttgagacggagtctcactctgttgcccaggctggagtgcagtggcgtgatctcggctcactgcaacctccacctcccaggttcaaggcaattctcctgtctcagcctcctgagttgctgggacaacaggcgcacaccaccacgcccggctaatttttttgtatttttagtagagacggggtttcaccattttggtcaggttggtctccaactcctgacctcaggtaatccacccaccatggcctcccaaagtgttgggattacaggcatgagcctccatgcccagccaagaatgtatttttaacaattagtattttacttatcacctaaagtataaaacaaatatctgtaagtccatattgatataaataattacattaataaatgaggaaagagacaaagaatagactgatctcccttagagaagaattccaaataatggtagattcttccatcttccagagggtcctctataactttccccatctccttggagtgtgggctgcacttagtgacttgcttcctaagagtatggaatgggatgactgtgtgtggaggtggtggtgataatcttacagtggctaaacctgcaaatgctacctgagccaggtggtcgaggctgatgtattaggtgtaaatcatgttggcacgtgcccttgatagaattgttatgaaaagattcaaaccctgtaaaatatttgaaaagatttattctgagccaaatatgagtgaccatggcccgtgacacagccctcaggaagtcctgagaacatgtgcccaaggtggtcggggcacagcttggttttatacattttagagaggcatgagacatcaatcagatacatttaagaaatacattggttgaccgggcatggtggctcacgcctgtaatcccaacactttggaaggccaaggcaggcagatcacttgaggtcaagagttccagaccagcctggccaatatggtgaaactccgtctctactaaaaatacaaaaattagcctggcgtggtggtgcatgcctgtaatcccagctactcgggaggctgagtcaggagaatcacttgagcgcagaaggtggaggttgcctggcccgaaggcatttgtttaatttccttttgcttccaatgtggctgttaagaaacctaaagttggctgggcacggtggctcacgcctgtaatcccagcactttgagaggccgaggcaggcagatcacgaggtcaggagatcgagaccatcctgggtaacatggtgaaaccccatctctactaaaaatacaaaaaattagctgggtgtggttgcgggcgcctgtggtctcagctaccagggaggatgaggcaggagaatggcctgaacctgggaggcggagcttgcagtgagccgtgattgcaccactgcacatcagcctgggcaacagagcgagactctgtctcaaaaaaaaaaaaaaaaaaagcctaaagttattctcgattctttctacgtgactttttttttttgagatggaatctcgctttgtcgcccaggctggagtgcagtggcgtgatctcggctcactgcaacctccgcctcccgagttcaagcaattctctgcctcagcttcccgagtagctgggattacaggctcccgccaccacacccggctaatttttttgtgtttttagtagagatgggctttcatcatattggccagactggtcttgaactcctgacctcctgatccacccgcttcagcctcccgaagtgcttggactaaggcgtgagccaccgcgcccggcctgcatgacctgttttttttcctccctctctggaagtatagagaatattctctgggactgggtgtggtagctcacgcctataatcccagtactttgggaggccgaggtaggaggatcacttgagcccaggactttgagaccattctgggcaacatagtgagaccctgtctctacttaaaaagaaaagagaagagaagaaaaagaatattctcttgtcaccaaaatattttaattttcttaggacaatttttttggggggtcaagttctacctttagaacagtgccttgaataaagtagaggctcagtaaacatttgaggaatggatggatgttactcttttggggctggccagatttctttctttagttctgttcttttctgttctattctgttcttttccttttcttttctttctctctctctttctttctttttctttgagtttctttcttgttgcccaggctggagtgcaatggggtgatcttggctcactgcaacctccgcctcctgggttcaagtgattctcctgcctcagcctctcaagtaactggggttacaggcatgtgccaccacacctggctaattttgtatttgtagtagagtcggggtttctccatgtttgctaggctggtctcgaactcccgacctcaggtgatccgcccgcctcggcctcccaaagtgctgggactacaggcgggagccactgcgcctggcctggggctggccagatttctcgggaaaatttgcctgtcttttttttggaggcgaagacctagctgccctaccaggtctacaaaccaagtggtggctgagagttggtcatctcccaggttccccctggtgctgcctagctcagttcttctgcagctccctgccatgcttgtagtggacatcgcagtcgcacttcttagtttaaagcatccacctaatgcagttgtgtgtgtgttatgctgaacgttgaggatgtgttttgaggaatgcatcgttaagtgatttcgttgtgggggcatcagggagtacatttacacaaacctaggaagtataacctactgcacacctaggctgtatggtgtagcccattgctcctaggctaaaaacccatacagtatgtggctgtggtaggcagctgtaacagtggtaaatatttgtgcaactaaacatatctaaacatagaaaagatatagtcaaaataggtgttacaatcctttttttttttttgagacagagtctcgctctgttgcccaggctggagtgcagtggcacaatctcagctcactgcaagttccgccttctgggttcatgccattcttctgcctcagcctcccgagtagctgggactacaggcacccgccaccatgcccagctaatttttttgtatttttagtagagacagggtttcatcgtgttagccaggatggtcttgatctcctgacatcgtgatccaccagcctcagcctcccaaagtgctgggattacgggcatgagccaccatgcctggcctggtgttataatcttatgggaccactgtcaaatatgaggtccctcattgaccaaaatgtcattatactgcacatgactgtattgtacagaatttgtctattgtaaatttgttagtttgcgtcatatctatcagggagttagttaaaattcccaaggccttctcttttagtcattagtgtgacagagtaagtaaaatatcactcctgtcataaaggacgaattaaaaggacagttttagtgtgtaatgagaactattttctgagacagtcttgcttgctctgtcacctacgctggagtgcagtggcatgatcatagctcacgcagccttgaactcctgggctcaagccatcttcccacttcagcctctcaagtagttgggagtacaggcacatactaccatgcccatctaatttttaattttttaattaaaatattatatgtatgcatatatatgtgtatatatacatatttcagacaaggtctcactctgtcacccaggctgaagtgcagtggcacagtcatggctcactgcagccgtgaactgcagacatgcatctttatgcctagctaattttttttctttcttttttttctttttgaaaagatgggacccctctatgttgcccagtctggtcttgaacccctgggctcaaacgatgtttctgcttcagcctcccaagtagctgggagtacaagcatgtgccaccatgcctagctaattttttttgtttttttgtagagatggggtcttgctgtcttgcctaggctggtcttgaattcctgggttcaagggatcctcccacctcatcctcccaaagtgctggggttacacacatcagccacagtgtccagcataagaactatttctatttttcatattacctctgcttggattactttagaggtaaagcaactgaatatacaaattcatatttatgtctggtgtttttgtcagagctgagtggtagaactttcgttgtagtctgtatattaggttttattgcatgccatctcttttcagttacacgggtacaaatccttacctgtcaagtaggatgttgaataatacaaacatgctacagttaccttgtctatccgaactgttaagccttatttcaagtttgagcatgggttttttatttactttctttatccagaaactttttttttatttttatttttttgagacggagtgttgctctgtcacccaggctggagtgcagtggcaggatctcggcttactgcaacctccactttccaggttcaagcgattctcctgcctcagcctcctgagtagctgagactacaggtgtgtgccaccacacccagctaatttttgtatttttttttttactagagatggggttttgccatgttgaccaggctggtcttgaactcctgacctcaagtaatccgcctgcctgggcctcccaaagtggtgggattacagggagagccactgtgccttacccagaaacttttttgttattgtttcttatatttccaaaaggcaggtaagccttttgaaaggatggcatggccaggcatggtggctcacgcctgtaatcccaacactttgggaagccaaggtgggcagatcccaaggtcaagagatcaagaccatcctggcatacatggtaaaaccccatctctactaaaaatacaaaaattagctgagcatggtggtgtgttcctgtagttctagctacttgggaggctgaggcaggagaatcgcttgaacctgggaggtggaggttgcattgagccgagattgtgcaactgcactccagcctggcgacagagcaagactccatctcaaaaaaaaaaaaaaagaatagcatttcctaatttctgtcccagtgggtagtttgtaaaagaccaggtctatttgtattgggtttttttttcttttgagacggagtctcgctcttttggcaggctggagtgcagtggcgcgatctcggctcactgcaacctctgcctcccagattcaagcaattcttctgcctcaagctcccgagtagctgggactacaggtgcacgccaccacgcctggctaatttttgtatttttattagagacggggtttcaccatgttggccaggatggtctcaatctcttgacctcgtgatttgcctgccttggcctcccaaagtgctgggattacaggcgtgagccaccgcgcccagcctgtattgtttttcaaatgacattttaaaaagagtaaaaattgttttatttctaggttacaaaatgctacagacaggattttaacatttattttgatttattttttactcctggcaagttgcgatacaggtatttaatcagaggtcccaatgtggagcctgacaggataggttcttaacattctcaatttatgtcctcagaatgtggtagtacgaaagaatgattgaagtaaatctttggacttgagacttgtggcctggcatggtggctcatgcctgtaatcgcagcactttcggagggtgaagtggacaggtcacttgagcctaggagttgaaggccagcctcggcaacatggcaagaccctctctacagaaaataaaaagaaaataaaaaagaaagaaaaattagccaggcttggcggcacgcacctgtagtcccaactacgtgggagactgaggtgggaggatcacttgagcccaggaggtggaggttgtaatgagccaagatcatgccactgcacttcagcctgggtgacagagtgagaccctgtctcagacaaaaaaggagaatcatgtatgttaaaaatacatgtcaaaatggcacagtgggctgggtgcagtggctcatgcctgtaatcccagttctttgggaggccgaggcgggcagatcacctgagctcaggagtttgagaccagcctgggcaacatggcgaaactgtgtctctactaaaaatacaaaagttagctgggtatggtggtgcatgcctgtagtcccagctacttgggaggctgatgtgggaggatcgcttgagcccgggatgcggaagttgcagtgagccaaaatagtgccattgcagcccaccctgggtgatagaatgagagcctgtcttaaaaaaaaacaaagaaacagtacagtgacaattgcctatactcctagctccttgggagactgaaggtggggaattgcttgagtctaggagtgcaagtccagcctgggcaacatagcaagaccccatctctaaaagaaagagaaaaacatgaaaaccacaatactatataattgcaaaagttgagtcactatctaaaataatgtaaacaaaatgagttctaaaataaaaataacaattatagggtttttttggtcttcattatgttaggtagtgacttacagtctgtagacacagtacataatttgttaggggcctggtgtgatagctcatacccatatctccagcactttgggaggccaaggtgggaggatcactggagcccaagagttttagaccagcctgggcaacatggtgagacctcatctcaaaaaaaaaaaaaaaaaaaaaagaatttgttaggtttacttgaatcctgagactttaaatttagtagactgtaatagctttgcctgttgaacaatagccttaaagaggtttgaccctaaaaagggcttcttatgtgttttttttttttttcgagacggagtctcgctctgtcgcccaggctggagtgcagtggcgccatctcggctcactgcaagcttcgtctcccgggttcacgccattctcctgcctcagcctccggagtagctgggactacaggcgcccaccatcgcgcccggctaattttttgtatttttagtagagacggggtttcaccgtgttagccagggtggtctcgatctcctgacctcgtgatccgcccgcctccacctcccaaagtgctgggattacaggcgtgagccaccgtgcccggcagcttcttgtgttttgggagcttaattcagatgttagatttatcaggttttacactggagattttgcattgagttcttttggtctcacggagtaaataatggaactttaaataggactttttttttttaaggaataaaagcataataaaaaaagttcatagttagaataacctggggccagatagcttgtgtgtcagtcagagggaaagagggaagggagtatttctgagcctgtactattgttccaggtcaggtgggtatcaatttcacttgacgtacagggagactgagcctccaccacaccccagggtaggtgagaagaagatgcattagctccaaagctgcttcattcattcattgcacacatctttattgcatgcccgtgggttgctaggcattgttttggctgattccttgttccattgaatcatctccaggcatacacggcatgagagttggaagatggtccagtgatggtgtgatttataggctggcaaaatgtttgagtcaacttagatactgagtaatttttaccttgcagaaatcagtaaatcagtgttacctgttacttagcggtagcctgtatactttttttttttttttttgagatggagtctcactcttgcccaggctggagtgcagtggtgcgatctcagctcactgcaacctctgcctaccgggttcaagcgattcttctacctcaacctcccgagtagctgggattgcaggcacctgccaccacgcctggctaattttttgtatttttagtagagacggggtttcaccatgttggccaggcttgtctggaactcctgacctaagtgatctgcttacctgggcctcccaaagtgctgggattacaggcgtgaaccaccaagcccagccgcctgtatacttttgaattcttcatcttgaggagctgcaagatagttttccctcagaaacgcattttgtttctgcatcaaacttgaaaaatgtcctaagtagacttgtcagtcgtttacagttttataccttatttatttatttatttagtgatggagtcttgctctgtcgcccaggctggagtgcagtggtgagatctccgctcactgcaacctccacctcctgagttcaagtgattctcctgcctcagcctccataatagctgggattacaggtgtgcaccaccacgcccggctaattttttgtatttttagtagaaacgggtttcaccatgttggccaggctggtcttgaactcttgacctcgtgatccgccagcctcggcctcccagagtgctaggattacaggcgtcggccaccgcgcccagcttgccattacttttattcatagaatgatctttagtttgacctacgtgcatatagacttttgcctgtatttccttctagtttcttggtttttttttaatttagttattaatctggaattcatgttagtatatagtgagtgtaggagtttaactttattttatttttcctaaatagccagttgccttggcaccgtttattatataagctgtctttggttataatggcttagcctagaaatggtgagaggtatcgagtctaaatatacatgccgctgtctgtttccctctgaagaagtggcacgtgtacttaacatctataccatggtcacctggggggcaggtttcttgtgctctcactccgtgctgctcctctagccttggtactgggtctggctttgcagtgatgagcagctgctcaccagcagtgggtgccgtcacacctctgcctcagctcccctttgctgccgggctggcagtgcccttagcaatcttagtagcccttactagccttgagaggtgctacttgataacactggcttcccttgggagtggtttcttctgtctggccttcgtctctcagttggccattgccccccaccaccgtgttccgccacacagccactgtccctgagccttcaggtctttgtgcacctgcttgtgtagcttgtcttctgctagcttgcatgtccccaagggcgaggcccttattaatctgtacattccagggcttagctcagagtaagttttagtaaaacacttgcatctgctagtttgggaaacataaaagaatatatgttgcatcatttggatataatacataaatactttgctgtcagggtggaaaaacaggccttaagttttattttcctcctcctgaagacccttcccttcagtcataggaacctcaaagatgttcagatcaacactttaacctagtacattttaatcttgtttgttgaaaactggtccttaagtgttttctttcactcattttacaaatgtgtattgagtgccaggccggggatatatcatggaacagtatggatgaggtccctagtggagcagcagtatcactcagcaatatattcccagcctggcacaccatggatttgctacagtgaagctggagagccctgtgttaaataaatactaacagttaacatactgtcaggtagaggagtggcctttgttcttttttttttttgagacagaatcttcctctgttgcccaggctggagtgcagtggcgcgatctcggctcactgcaactcctgcctcctggcttcaagcgattctcctgcctcagcctcctgagtagctgggagtacaggcgagcgccatcaggctcggctgatttttgtatttttagtagagacgggggtttcaccatattggccaggctggtctcgaactcttgacctcgtgatctgcccgccttcgcctcccaaagtgctgggattacaggcatgagccaccgtgcccggtcggcgtttgttgttttgttgttttctggcctctttgttagtggagtggaggtggatttctgaatagtcttacagacaacttccaaattttaaaaggaattcagtcttcatatgtatggaaaaagaaaatcatttttccagtgtgtgatgcagagactaacgtgaccctattctcaagcactcatagcttcaccccaaaatcctggaatatatagtctgtatctgctgattcagcttttcttcccttcatgcagcgtctgtcagtccatccattcactacatggactttctgggccaggagctgcctctagaagctgtggagtcctacaagatcaagtccctgccttttttctttttttgggaattttttaaagagacagggtcttgctccgtcacccaggctagagtgcagaggtaccatcatagctgactgtcacctcaaattcctggactcaagcgatccttgtgcctcactgagcctcctgggtagcaaggaatacctgcacataccacccagctaattttacttcatttatttttatttatttatttaggcagagtctcgctctgtcacccaggctggagtgcagtagtgagatcttggctcactgcaacctctgcctcccgggctcaagtgattctcgtgcctcagccccctgagtagctgggaccacaggcgtgtgccagcacactcacctaatttttgtatttttagttgagacagggtttcgccgtgttggccggctggttttgaactcctgccatcaagtgatccgcctgccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctggccctggtggtgcttcgctgtgccatcctcatctgtgagcctgcccggtgaccgtgctgcacctgtccttgatgccctgtgtcttccaggtctgctcctcccctgctgctcttcctgttccatgttctttggctggtttttctttcttcttccagctgtgtgactccttttcaagcctttgtccagttaaacattttaccaagaatgtagtgttcttcctgcatttcattaggaagagaaaaaggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgtattgattgattgattgagatggagttttgctcttgctgcccaggctggagtgcagtgatgcagtctcggctcactgcatcctctgcctcctgggctcaaatgattctcctgcctcagcctcccaagtagctgggattacaggcatgggccaccacacctggctaattttgtatttttagtagagacagggtttctccatgttggttaggctggtcttgaactcccaacctcacgtgatccacctgcctcagcaaagtgttgggattacaggcgcgagccaccatgcccggcctctgaattttatttttatttttatttttttgagacagtgtttgctctcgccgcccaggctggagtgcaatggctcaatctcagatcactgcaacctctgtcccccgggttcaagtgattctcctgcctcagcctcccaagtagctgggattacaggcacataccaccattcctggctaattttttgtatttttagtagaaactaaaatgttggccaggctggtcttgaactcctgacctcagggcctctctgaattttgaaaagcggatccaaaatagtggatactgctgtgtatcatttaggatttgatttggctgccagtatcaaaaaaacaaaaacagtggcttaaaccacaagatgtttgtcaaataagtactgaggtacactctcctggacgggttctgtagctacacagtcatcggggatactcaggttcctaacatctgccacactgcaccttggcagcctgtcttggggactgagagtgagctccatgtggccctgttctagcataggggaagggaaaggaaggacgtgcctccttccttgaaggctgctgctttgatgatgtgtacagcagtgcttacattgcattggccagaccttatggctgtacctgggtgagtgggagactggggaatgttgtcttcccacttacagtggcaggtccttaagcctaaggaaggagaatggacactggccagtgggtgatggtctctgcaatcccagggccagattgcttcatatctttgactaacctttgtttctataatatcatgcttgacatagagatgaaaacactggaaacatctaggtttttaaatactctctcctgataacttctggctctgtcagcatatcttaggtaaaattaaatataccaaagctttgcttctttcttagcattctctagtttagtgagtgaatagagcagaagaggggctgctggccagcggtttctgctttcatagaggaagtgactgcccacaccctgattttagagtcttcatcctaaccatgttacagccttgagttgcagaactgtagctctgtttggatattgtgaacgtattatttctcaagttctgttaccttgagaacaggtgacatgaatttaaacttgcttttttggtgtcgcagataagagttttaaaaaaagaaggaagaaaaggtcccaccttctggagtttcaggttttaaacctaggaggataataacctggttattatgttatgagagggatgggcagatgtatgttctaaagagagaacagattgctgccagccagctcctagctgtttgtgctcttatgctcctaggaacttgccacagcctcacgctggtctgttccagaaaccagtgagcactctgtaggcagagccctggagtggcccctggattttatgacataaacataagcttatgagtgcaccagtgcattcttactcttggtggtagctacagagatgtcttctctcaccttggaacatcaaggaagatttgtatgtgcactgttctctgacccccacttgcagcccttcaccaacatgcactctgtgcgcagacatgcatgtgtgtacacgaggtcttacacatgggaaagggtctataaaaaattatgttgggcccatcttgatagaaagtaaaataatacagtttcatcagaagggtagctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttttttacaaggagtctcgctctgtcactcaggctggagtgcaatggcacaatcttggcttactgcaacctccatctcccgggttcatgtgattctcctgcctcagcctctggagtagctgggattacaggtgtgtgacaccatgcccagctaagttttttttttttttttttttttttttagtagagatgaggtttcactgttttggccaggctggtcttgaactcctggcctcaagtgatctgcccacctcagcctcccaaagtgctggtattccaggtgggagccaccatgcccagccttctttctctgttggctctatttggatgtttatcctagtctcagttatttttcattcaacatttatttctgattcagttaactttttttttttttttttttgagatggagtctcactctgtcacccaggctggagtgcagtggcacgatcttggctcactgcaacctccacctcccgggctccagcgattctcctgcctcagcctcccgagtagctgggactacaggtgtgtgccaccacgcctggccaattttttgtatttttagtagagatagggtttcattgcgttagccaggatggtcttgatctcctgaccttgtgatctgcctgcctcggcctcccaaagtgctgggattacaggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatcccatcatgagggccccacactttcgagctcatcttatcctgatcacctcccaaaggtttcatctctaaataccattacactgggggttagggctttaacataggaatttggggagaacacagtttagttgacagcatgctatttcaaaaggcttaccaaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctcaaaaaagaaaaaaaaaaaaaaaattaaggccgatgcggtggctcatgcctgtaatcccaacattttgggaggctgaagcgggtggattacctgaggccaggagttcaagaccagcctggccaacatagcaaaaccccttctctattaaaaaatacaaaaaaattagctgggtgtggtagagtgcacctgtggtcccagctacttgggaggctgaggcatggaattgtttgaacctgggagttggaggttgcagtgagccaagatcatgccgctgtactccagcttgggtggcagagggagaccctgtctcagaaaaacaagcaataaataaataaataaataaataaataaaagatgcttgctctagagtgctatggaaatgcaagtactttgcagatgtcgatgccagcagtgattgacctgggacattggaggatgttgagaagaagaaaactggtttcgtaggatcggagacttttaaaatttattattttgaaaaagtgttaaacttggagaaaacatccagtgagctggctctccttaccctttccagagtacttacgagtgcctgtttcttctgaaacctgttcacatagtggcatagcatgtgccacggctgcttactgctgctgggcgtctttccctagggtgaggggttctcctgtggcagtccagggccaagggcactcaggaaattgcacacagacccagtatgtcctctcctctgcagctcatactctccttttgttaactgccaacagcatccttcatggcattgtttcactgtgtcccagggtccagttcaggggtacatcctgcatgtggccgtcacatctgttgagtagcctttcacgtggaatggggtctctgtctctggttgtctttcatgacattggtgtttttgaagaatgcaggccagttattttgtccatcattcctcagttggggttcgtctaatgcctggattatgcatcccagacaggaatattctaaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctcggtgcagtccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacaggctagtcacttttgtttacctactgaattttacctagagacaatgtttttaaccatcttgccccttaaaatatatttttatgtatctgtataaactatttttcaaccatatccacttctctttaaacaggggttaaattaaaaatatttagcaagcttttttttttttttgagacggagtctcgttctgtcacccaggctggagtgccggggtgtgatctcggttcactgcaagctccgcctcccgggttcacgccattctcctgcctcagcctcccgagtagctgggacttcaggcacccgccaccatgcctggctaatttttttgtatttttagtaaagacggggtttcatcgtgttaaccaggatggtctcgatctcctgacctcgtgatccgcccgcctcagcctcccaaaacgctgggattacaggcgtgagccaccgcgcccggcctatttagcaagctttgtggaagggtgtcactgaatcagaagaacagatgctgcccgtgaccactcagttcagcttgtttagaatagaccacagtgtacccctaacgccagccaaacgaagctgttttgaccttttccacaagaccctgtgcaggcggcttcttttgtctaaatagccttcccacttggcctggcggtgtcttcctgccttctgaggcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcctcaccttcctgagtagctgggaccacaggcatgcaccactacacccagctaaattttatatatttcatagagacagcgttttgccatgttgcccaggctggtctcgaactcctgggcttaagtgatctgctcagctcggtaccccatagtgctaggattacaggcgtgaaccactgcacttggccaaggcttttttttttttttttttttttttaaacttatatgcccattaaaacatatggaagtttctggacagcactggatattattaatataaatgagttaagtaagcataactaggtttttgttgtgcacagcgtgcatgggcacacacatcactgctgggtgctggggatgccatggcctctgtcagtcttgtgtttttccctagcattatagtgtgagagttgacccacgtgcgtagatgtttgggaaaaaaatagtagctacatatgtattcatattcagtattctacctttcagcttgttatttcatcattcttgtattaagggacacataattttaagctttttttttttgcctttaatattttactgatctttataaggtttgttcaagattttggattgattgattggttgtagagatggagtctcaccatgttgctcaggctggtctcaaactcctgggctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttgggaccacaccggagaaccactgctaactaatagtcccagacattttataatatgtcatcgtttacagaagtgtttaatatacctcatctcatttaattcttttttttttttttctgaaacgaagtcttgctcttgtacccctggctggagtgcaatggtgtgatctcagctcactgcaacctctgcctcccgggttgaggcgattccacccaccccggcctcccaaagtgctgggattacaggcgtgagccaccgtgcctggccattttttttctttctttttttttttttttttgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtggcacgatctctgctcactgcaagctccacctcccaggttcacgccattctcctgcctcagcctcccgagtagctgggactaaagccgcctgctaccacacccggctaatttttttgtatttttagtagcgatggggtttcaccatgttagccaggatggtctcgatctcctgacctcgtgatctgcccgcctcagcctcccaaagtgctgagattacaggcatgagccactgcacccggccctgtggtttttcttaaatagtttaagcttaacttttatttctgtagttgaaaattacatttaaaaaagctgtagtgaggccgggcacgatggctcatgcctgtaaccccagcactttgggaggcctaggcgggtggatcatgaggtcaggagtttgagaccaccctggccaacatggtgaaatcccgtctctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttgagatggagtctcgttctgtcaccgggctggagtgcggtggcgtgatctcggctcactgcaacccccacctccatggttcaggtgattcttctgcctcggccttccaagtagctgggactacagggacacaccaccacgtccacctaatttttgtatttgtagtagagatggggtttcaccatgttggccaggatgttctcaatctcttgacctcctgatccgcccgccttggcctcccaaagtgctgggattacaggctgagccactgtgcccggcgctgttttttgtgtttttaaaaatttttcggttttaggttttgagaaataaccactgtgatgtgtttttaactgactattagctgaaaacaactcatttaattagagaatagcccacaaaacaaagccagattggcccatacaaatcagtgtttaagactcaattacaggctgggtgcagtggctcatgcttgtaatcccagcactttgggaggccaaggtgggaggatcacttgagcctaggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaacatgattaaagataaattcaccaaatatgctttatgaagctgaaaaatgaaataattattattataactaaagattaactcagagctatagattaagtcaatgtcatatatatttaataccagctgctacagttcatggtaattaggtattaaaaaatataacaacttgttcatttcagcagtgctgtgtatgacaatctctttagatgttatgaagattcgggtattgggtctatccgatgagtgaccacaaattgtgtttttttttttctgaaacggagtcttgctgtgtcgcccaggctggagtgcagtggcacgatctcggctcactgcagccttcgcctcctggattccaggaattctcttgcctcagcctcctgggtagctgggattacaggcatgtgccacaacacccggctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggctaggagaagagcatcctgggcaactgggacagctgtgggctcttcagaagctggcagtaaaactcacatagcctttacaaagcccatttccttatcttcaaaatgtgcctaatgtgtacatttgtacatagtacaaccaatgtacaaaaatataactaccatgaaggattactacagtaattaacacagctaaagaagatgagcacagttccctccctcccctcatgaataagaatttgagaaattctggttattttattactacgtggtgtagcgagccagttaaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaaaaaagacaccacagactaagtgacttgtgtgaggccccgtagctgagaagcagttagactgggattacagtgcccagagcccataacatgtcctcattgcagagacctatacagttcacgcagaaatggagacaggagcatcacccaaatccatcttcatgtcctcattgcagagacctacccaattcatgcagaaatggaaacaggagaatcacccaaattcatcttttcacatttttaatgtctttccttccttctgtgcctttggtttacagatttcaaaccataccgtccatatcatcatgtatactgcttattttctttacatttttagtgtgagtacctttcagtcataaaaatattttcataaacattacttttaaggtggctttttcctccatagcatgggtctgttggttgtctagaaacttgcgtgagtgttccgagaagatgacttaaaacgaatattgattcgtatgcttgttttcttttttttttttgaggtggaatttcgttcttgttgcccaggctggagtgcaatgatgtgatcttggctcactgcaacctctgcctcctggattcaagtgattctcctacctcagcctcccgagtagctgggattacaggcacacaccaccacgcccggctaatttttgtatttgtagtagagacagattttcaccatgttggccagactggtcttgaactcctgacctcaggtgatcctcctgcctaagtcccccaaagtgctgggattacaggtgtgagccactgcacccggccttgatttgtatcttttctacttttgctagcaacatcttgctactttttcttagactattgtttaatgtttttgtttagtgctcacattctgaatactcccttgtgctacttgagcagctggcattttagaaattacattccagggccctagcatttgctggggtgtcttgacagttgctcacctgtctcaggacattgattctgtaccctgtgtcttacctgttgcttggtgtccagctctgtcgtccatagactttttcctccagtgtgaacctaatctgtccatgctgtaagaagtagtatctaacaaggatcatataaaaaagaaaacaggctgggcgcggtggctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgctggagacacagatccacacacactccttttcctcacagcccatggggccttgtcctctgcagagggaagtgtaggcccctccgtggccggcccgagagccttgcctcttgagcccgagcctgtgcagactgccctctgtgatggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaattttacagtttcagaaaagtacaagagaaagttaaaatatattcaagccaaaacagaagtctgttagttctttagattatgtgctgttgatagtggttgttcagagcttatatgtcatagttctgtatgtcatgtgctttcttacagtccaactgttacaaccactctaaaaaaccttggggcactttacagacgtcaaggcaaatttgaagctgcagaaacgttagaagaagctgctatgaggtctcgtaaacaggttagtcatacttctgtccttaaccggcccatgggaactttgaattgaatgcttctcttttacatgaattttattgaaagcttgatttagaaatagaaaatgttgattattttagtttgaacaaataaagttatattgtttaaaagagcatgaggccgggcgtggtggttcacacctttaatcccagcactttgggaggccagcgtgggcagatcacctgaggtcaggagttcaagaccagcctggccaacatggtgaaaccccgtctctactaaaaatacaaaaattagctgggcgtggtggcacacgcctgtaatcctgtaatcccagctactcgggaggctgagacaggagaatcgcttgaacctgggaggtggaggctgcagtgagccgatatcatgccactgcactccaacctgggtgacagaacgagactccgtctcaatttaaaaaaaaaaaaaaaagcatgaggctgggcacagtggctcacacttgaatcccagcactttgggaggccaaggtgggtagattgcctgaggtcaggagttcgagaccagcctggctagcatggaaaaaccccatctctactaaaaacacagtgcagtggcacaagcctgtagtcccagctactggggaggctgaggcaggagagtcgcttgaactcaggaggcagaggttgcagtgagccgagattgcactactgcactccagcctgggcaacagagcgagactccgtctcaaaaattaaaataaaataaaataaaatagcatgaatatgaccccaaaagcatgaacagcaaaataaaaactagatctgttggattcaccaaagttaaaagctcttgtgcatctaaggacatcatcaagaaagtgaaaggggactgggtgtggtgctgagcacctgcaattcctgcacgttgggaggctgaggtgggaggatcccttgagctcaggagttggaaaccagcctgggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaagaaaaaaaaaaagaaaaagtgaaaagacccccatgcaacaggggaagatatttgcaaatgatgtatctcataaggttttggtatccagacaaaaagacaacccagttaaaaaatgagcaaaggacctgaatacacattttactgaagatgatatacagatagccaacaatcacatgaaaagatactcaacatctttagtcattatagaaatattaactgaaatcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccgagacaagaatcttgctctctcgcccaggctggagtgcagtcacgctatctcggctcactgcaacctctgcctcctggttcaagcaattctcctgcctcagcctcctgaggagctgggattacaggtgtgcgccaccacacctggctaatttttttatttttagtagagacagggtttcaccatgttggccaggctggtctctaactcctgacctcgtgatctgcccgcctcggcctcccaaagtgctgggattacaggcataaaccaccgacttttcttattttttaaatggtagggcagtatgcacataggtattaatttttaatcaacttttttgagggataattagagacagtaaaaggggcccattttaactgttgtctgatttaaatattaacacggttcaggtcagcacattagtttgtctttatatagatgttagaacaaagtttctcatgctgtttctgtttaagtgaaaatttccctgagattgcaaagcaaaccgttaccactgtagccacttacttgtgtgcatcaagatttttttcagtattatgcaattaagttaaaatagagacataggtgttgaggtaaatgttaagactataccttgccgggcgcggtggctcacacctgtaatcccagcactttgtgaagctgaggcgggcagatcacgaggtcaggagatcgagactatcctggccaacacggtgaaaccccctctctactaaaaatataaaaaattagccgtgcatggttgcgggcgcctgtagtcccagctactcaggaggctgaggcaggagaatgatgtgaacccgggaggcggaccttgccgtgagccaagatcacgtcactgcactccagcctgggtgacagagcaagactctgtctcaaaaagaaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttgaaacctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatctctctcagtatccctgataacctaagcccttagaactgttgccatacacggccagggtgcggggtggccagagatggcccagtcccttagtggtagggctcaccctcttgtccgcttggtatccctgtgggagtctctgtcgtggatggagacttctcttcatggctgtgagagaggtgcaggcctgaggcaagaggagtgacgtggcttttgtaaggagcttctcacaactgttttccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggggaaatggattttaaattgcctttggaatagtgatcttattttaaaatgtttacagatttccagaaccaaaatgatagattactatctgcctctcgatgaattttgagattacacatttcttcttaaacagcattgagagggttggagcagtgctgtgtgactgcttggtgtcgcttccttggaatgatgtgaggtgtcacacagcagctctcagatcccctccaggaattacatgatgcccagagagagcattctggacattatttaattcctggaggggatcacactgattgtttgaggttcttaagttttgaagccttttaagtgcagagtccagttctggtgctgagtgttgtaacttggaccacactcccacatgacagctctcagagttgttctgttttctcgtgttttgtgtctttgccgtgataaaaatgtagcagtgtgtgaccagtccccagtgttagaactgtggtcagtgttcatggggctgtagcactgccagcctgaaccatgtgacatagatgcacacacttgcacggactaacgttttctacatgactttggaaattgcatcccgtaaaatgcatacaactgaataatctttccaaataagagtgactgtttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcgtgatctcagctcactgcaacctctgtctcctgggttcaaatgattttcctgcctcagcctcccaagtagctggaattacaggcacatgccaccatgcccagctaattttttgtattttagtagagatggggtttcaccgtgttgctcaggctggtctcaaactcctgagctcaggcagtctgcccgcctcagcctcccaaagattacaggtgtgagccactgcagctggtcttttttttgtttcgttttgttttaaagagagacagggtcttgctctgtctcccaggctggagtgcagtggtgcagtcatggctcactgcagccttgaccacctgggctcaagtgatcctccacttctgcctcctgagcagctgggactacagatgcatgccaccacgcctggctaatttttgtatttttgtagagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcactttttttttttttttttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcatactttgatcatctccttatttcctccacacacaaggacccctgcactgccaatggccccaggagagggcagagtcagccacagggaccccacctcacaggcttcaacactgctgatgcctgtcatcccagcaccgtgggaggccaaggcggccaaggtcgcctgagcccaggagttcaagaccagcctgggcaacacagcaagacctactctctaccgaaaaaaaaaaaaaaaaagaaaaatagctggccagtgtagtggcgcttgcggtcccagctacttgagagcctgggaggtcgaggttgtgcctagctgtgaagacgccactgcactccaccccggatgacagagccagactgtctcaaaaaaaacaataaaaattcacgccttgtaataaggaattaaaggcaggatgaacaaacattttcttcttttttttgtgtgctttctgagatggagtctttttctgtagcccaggctggagtgcagtaatgtgatctcggctcactgcaacctccgcctcccgggtcctggttcaaacaattctcctgcctcagcctcccaagcagctgggattacaggcacgtgccaccacacccagctaatttttgtatttttagtagagacggggtttcaccatgttggccaggctggtcttgaactcctgacctcgtgatccgcccgcctcggcctcccaaagtgctcggattacaggcgtgagccaccgcgcccggcctaaaggattttctttccaaatcaaagtattaaaataactgttcagacctctcccacttcgatgcgaagccagcgcggtcccaggcggacgagcgaaggcatcgaaggccgggggcgcagccgcgggcccacctcggcctcccctgagcggacgcctccccgcgcgcaccgggggccccggagaccgccttccccgctccgaacgcacgcggcccggccccggcgaggtgcctgaacgctacccgagctgcggcggggctcccggggtgagtgctgcagccccaggcccgcctgctcccacaggctcgggcaatggagacccgcggccgcccccgccccttgaccctgcctcacccctcacgcccgctgccgcccacgacctccgaccccgctgccgcccggctcgcagcccggctcgcagcccggctcggcgggcctcacctcccgcgggttccgcactcctcttcccgccgtcctgctcctctcggccttctcctccaataggcgcctagcaccctgagtgggctacaccaatcagagacgaagcggcgctaacgtgactgactaactaaccaatccaaagtctcaatctccctgagaggggcggagcgtacccgggccagccctcgccgccgattggtgatcgacctcagggttgcaggggcggtgcccttacacggattggagagggcagcgatggggcggagttcaagctccgattagtccgcgctccgtggcgggcttggcgattggacgccggcgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggtgggtggccgtcgccccggccagcgcctccgacccgccccgccgccccggcccggccccgcgggcttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaacagtcgcctggcatgtggtgatgctgaaggggacactgagctacactgtgctggctgcgtgcttggggccgctaaggtgattgtcgggaggtgactcaaatgtgcagataaccagttgtgggaaataggtttatttgaggtggtttggaatggggagaggagaatttggtagaacttggcaggtgggtaacattgtccttggcttggtggccgtgtgccgatcggcatcatcgtcatatctgtaaacgtgttggtccattttcattccagctctgttcttagccaggggagtctgaatccagcccagtgcccgtctcccgaataccagctgcctgaccgggctggtttatcagtttgggcccatgagggttatccctttaaaatgctgcaaaaccccctggggagcatgtgcacacatgcacctttctccgagaggtggcctgcagctctcagattctcaaggctctgacgcagaaccagttgagaatcgtttctccagtctgtgcctcctcaggaacctgtggggcaggggaggcagaggcggcgtgtaaagcttcgtgcgacaccactttggatagaggtgctttgggggtgtgaaggaagcttcagatgatctctggggcttgtctgactctgccatcaaatatccgacactgacgcaaggcagtgggcttgggggtgggcggtccgggcgtgcagccatctgggcttgtcacaagcagctgagatcctgagttttatccttaaaatccttgccgctgtgcacccctcccacctcccatccgtggtgctggcagaagaatgaccgcagctccatgctggcgggttgacactttgatggatactctagattcagagccaggaaggagagagcacgtgcgcgtctgatcacgagcctggactcggatgaggagagatctgaagtgaggactgttgctagaggcgtctggagctgtgcagcggggagaacaggggaccctgagttctgcgagggtctcacaggccaggccggacagggcttttcttttgcagggaggagtggccaaggctagaaagaatcaagctggggaggtgggatgggccagtggagggtcaggacctccagcagatcagagagctgaggccagaatacaaaaattagctgggcgtggtgatgagtgcctgtaattccagctacttgggaggctgagacaggagaatcacttgaacccaggaagtggaggttgcagtgagctgagatcgtgcagctgcactccagcctgggcgaccaagcgagactccgtctcaaaataaataaataaataataaaaattcaaaaattagtcgggcgtggtggtgtgtgcctgtatcccagctcaggaggctgaggcaggagaatcacttgaaccgggaagaggaggttgcaatgagccaagattgtgccactgcacttcagcctgggtgacagagcaagactctgtctcaaaaaaaaaaaaaaaaaagtccaggtaagggaattgtgttccagttgatcatgaggagaaatggccagtgttttctgaggcagagaatgggaatttggagggccttgctgcaggtaagcaaggggggcatctgtgatctcctctggctcgtatggggagggtggttctcggtggaaggctttcccagcacactgcagggtggggggtttcataattgtttccaggatctcagcgcttgggtaaagctcacccctgtgaggtgccaggggctgccagagcctccacaggtgttctgggaaccagcagcctcatgagatactgccagggacaccagcgagctcctcaagggtccctgtggctggctaagagctttttcttttttgagacaaggtgttgctgtgtcacccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactgatagtaacgcacgtgtttctagtccctgagatgcaagtagattttgtctctcagaggtgaagttgatgtcctctctcacacaccccaccgcggggtccctgtgagaggagccagtttacaactcatatcttccttcctcacggcctgtatccatgtctgctctttggattctcctttgaactgggtttttagtcttattggttctctcattaactaatgaggtaaatctttgacgtgggttccttttctgtttgtaggagttacgctctaccagttaaacgtgattatctttcaataaaggtgcattgatacatgcatttaaattgttttttgattggcgagttcttggggggctgagaattagttgactgtgggagccccaccagccagtgggtgacgcttctcactgtagtgtgggagctcagagtgcgtggtggggcctgatgttttttgtcaccccagcctcaaagggagggcaggcctatgtccatgtccagcctgtgtcctgagacttggttctttttataactttttttgaacatccatttaaactccctaaactatactttcagattatatggaggcgcttttggtttcttgcgtgctgccaaaccccactctttggggtgggccgggtgctggttctgaggagctgccctgtgaccctcgaggggccgttcctgttgcattggagtgggggagcgggtctcgacctgcaggtctctaaggagctccatgctggtgtctgccgcactgtggaggagtgatgggcttcatgatttctgttttttgttttgtttgagacggagtctcactgtcacccaggctggagtgcagtggcgcgatctcggctcacttcagccttcacctcccgggttcaagccattctcctgcctcagcctcccgagtagctgggaccataggtacccgccaccacgcccagctaatttttaggttttattttgtagggacagggttgtgctatgttgctcaggctggtctgaaactcctgagctccagcagtccacccacctcagcctcccgaagtgctgggattacaggtgtggccaccacgcctgacctggtttcttctttcattgctcgcggccatcttgcttacccaccgggaagcctagtttatggcatctgccttgaccgcctccgagcatgtcatctggcagggtgggtgcaagtcagttgtggtttactggactagcaaggaggggacaagcgcccagggctctgactcctgtaggcagccaggagaagtgtgttccgaaatttcactgggagccgtctgcatgcacctgccctgatcctcgctccctcttggc

SEQ ID NO: 1122 - DNA, 24640 bp, Homo sapiens
ttcctgatacacagcaagcccttagggattgggattgattattttcattctattgggtctttaatttagggcttcagaagcaatagacaaggaacttggtcattctggatatattggaatgacatgaattaaagataatttgtgaataggaaaagactttttcccctggacagtggagtactgggtagttttgtctgatgttattgaaaataatatagaaggtattttttgtttaattaaaaggaggaatagacagaaatggttttcttatagaaaaatgttctgttatagatggtttaaaacgaaggtgttttttatagtttttagaaaactcatgctttttttgcgcaatattctataccttgtactttatatttaaacaattaggaagagctactagataaactgcataaatgcttttttttttttttttttttgagacagagtctcaatctgttgcccaggctggagtgcagtggcgtgatcttggctcaccacaacctccgcctcccaggttcaagcaattctcctgcctcagtctcccaagtagctgggactacaagcgtgcgtcaccacgcctggctaatttttgtatttttagtagagatggggtttcactatgttggccaggctggtctcgaactcctgacctcatgacccacccaccttggcctcccaaagtgctggtgtgagccactgcactcggccaagtactgacatttctaattcaatcctcagtacgtttccatgtggtagcaaattttgtcctgatcctacagatgagaaaactgtggcttggagagatgaagtagcttgaacaaaatcacagagctgctgctgctgatgggacaggatttgggatgaggttagaatgggaaataggattgggtattgggtagaggttgaagtttgagtgttagaggacgaggttgagagtggtgtcaggaataggttgcagttgggatgggttgtggttgaaggtgggtcgtagttggggtgggttgtggttgggggtgggttatggttaggggtaaggatgggttgaaatggggtagtttgtggttgaggatgggttggaacagggatggtctggttgggggtgggttgggatggggatgggttgtggttggggatgaggatggggatgggttatggttggaagtggattgttgtggggataggttatggttgggggtgggttgtggatgggatggttgtggtttgggttggttgtggttggagtgaattgtggtggggaagggttgtggtggggatgggtggtggttgggggtaagttgtgatgggagtgggttgtggatgaggataggtcatggttggggatgaaaatggattggatatgggtaagaggatggagtggggaatggactagattgagtttggcattgaagttcacaggtgatagaattgggttgcatttgaaacatatgttgaggatggttgggatgctgcaaagttggttgttgagatgtttgaagaggttgcggatggtaatgaggatggtttggtgattggaaagaatgtagaattgggatggagtaggggcatgagggaaagggatgtgaatgagtttgagatttgttggtgatggagatgggacttgaagtggaggctggtattggggctggagatagggttgggctggtggttgatgttttttatgggaatgggttagagatttggaaggagatggggttgggattgcggatgatggtcaggatggggatgggattggagtgtggtggggatgggattgggtttcatgattggcactggaggaggtactcctcgccttggttcctgagggaagtgccatgcctgtcaggatgctggtgatgaaggtgaagaaatccagcatggacgggttggagccggtaaagaggatggtgcttattagggctatgcaaaggcagaagctggtgatgctggagaagaggaggaaggcccaggaaaggtccagcaagtctggggaaggaagataatcaggaacaccatgattggcccaggctctgagtatggggacaagggtcaccagttggtgtgggagtattctcaaagctcctcccttgcaaattatttattctcattttaggaaaatttaaattgggctccagagaagagacattgagactgatacttccagcactgaggatctacctctaggttggtgagggcagcttcttgggcagtgagaagtggggtgggcagtgaggagcattcccagaagtgaggaccactctagggctgtgaggacaatcctagggcagtgagaaccctctgaggcagtgaggaccgtcccagtcattgaggaccatccgagagagtgaggactatcccagggagtgacgaccatcccaggcagtgaggaccatctcaggcagggaggaccatcccaggcagggaggatcatcccaggcagtgaggaccatctcaggcagggaagaccatcccaggcagtgaggaccatcccaggcagtgaggaccatctcaggcagggaggaccatctcaggcagggaggaccatcccagggagtgaggaccatcccagtcagtgaggaccatcccagggagtgaggaccatcccaggcagtgaggaccatcccagggagtgacgaccatcccaggcagtgaggaccatctcaggcagggaggaccatcccaggcagggaggaccatctcaggcagggaggaccatctcaggcagggaggatcatctcaggcagggaggatcatcccaggcagggaggatcatctcaggcagggaggaccatcccaggcagggaggatcatctcaggcagggaggaccatcccaggcagggaggaccatcccaggcagggaggaccatctcaggcagggagggccgtcccaggcagggagggccgtcccaggcagtgaggaccatctcaggcagggaggaccatcccaggcagggaggaccatcccagggagtgaggaccatcccaggcagggaggaccatcccatggaagtaagggccatctcaggcaatgaggaccatcccagggtggtgaggataattctggggcagtgaggattattccaggcagtgaggaccatcctggaccagtgagtactatcccagggcagtgagaatcattcgagagcagtgaggagtatcccagggcagtgaggactatcccggagcagtgaggaccattctagagctgtgaggactatcccagggcagtgaggattatcctggggcagtagggactatcctatgacaatgaggaccatcccagtgctgtgaggaccatcctggggcagtaaggaccatctcagtcagtgaggatcatttcagtcagtgaggatcatcctgtggctgggaggaccaccctggggccgtgagactcataaaatacctgtgaagatcattgcaggaaaggaagaaaccattctgtgacaggtggaggggtccctgggataaagtggagcgatgggtcccaggagtggtgagggcagggcaggccttccaagcatcctggctgtgctcatgcaggcaggagatgtcacagcactgcttctcctcccccagaagtctagctcagaacttggcctccggcctgggcactgcctcatacctgccagaattgatctcaatggagctgcacaatgagaggttttgcatgttgtctagaggactttggttgagttcagagctgagcacacttgccttcagactctcctgggactcccaggtaactgattcaatgcttttgatactgggctcggggccgtaggtaagtgatgggagcacattgacaatggcccaggcttggaagttgggggttggaacacttaaatgggcagtctcggttgttgacaggtagttttggtcatgatctttgttgctggggataattgatgattagtcagggggtgagagccttggatactgaagcagcgagtttggaaaattggtgaagcacctcgcatactgaaatcgtggctgtaggtaatggctggtgtttctgggatactgatctgttgactgctgatagctggtgtagggtcttggatactgacctggtgattgtgaataattggcaaggggtcttggatactgaccaggcgattgctgctggctggtggaggctgttggatactgaccccgtgactgttcctggctggtggagggtcttggatactgacccgggaattgtaggtaattggcaccaccgtgcctggctaatttttttgtaattttagcacagatggggtttcaccatgttggtcaggcgggtctcgaactcttaacctcaggtgatccacctgcctcagcctcccaaagttctgggattacaggcataagccactgcgcctggcccttattattattttttaaggtatagaaatctagaatttttttttttttttctgagacaaagtctggctctatcacccaggctggagtgcagtggcatgagatctcggctcactgcaacctccgcctcccaggttcaagccatcctctcacctctgcctcccacgtagttgggactacaggggagtgctactattcctagctataattttgtattttttggtagaggtagagttttgccatgtttcccaggctggtctcgaacttgtaagctcaagcaatctgcccaccccagcctcccaaagagctgggattacaggcatgagccactgtgcccagccttagaatttttaggtagtttaatttcttcacctttgtctctgtgactttattaattgcttcttggcttcgggaggttctccctccagatttttgatgaacattcagttctgtttttttaaattctcattacttatttttaggttttgattgtgattttggagttggtatgcagggaacattgaattctgtgctccctgctgtcctaaggaagggacttgaattagtcaggagtttttgggtcacaagtgacacaaactctttttttttaaattttttttattttttacttttttaaatttgagatggagtttcactctttcacccaggctggagtgcagtggcgtgatcttggttcactgcaaccttcaccccccgggtttgagcgattctcctgcctcagcctccggagtagctgggattacaggcgcccgctgccatgcccggctaacttttatctttttagtagagacggagtttcaccatgttggccaggctggtctcaaactcctgacctcaggtgatccacctgcctcggcctcccaaagtgctgggattacaggtgtgagccatcgtgcccagccacaagtgacacaaactctaacttgaactagcttgagtgaactagttgtattagcttgagtgaactaacttgaactagctaggggatcctttatgggatcacctgagtgaaaaatggtaatggtaggaatgccttcaggcatgggtggatccaggggcccaagtgatagtatcagatattactgttttttggctatgggattggcttcattctcaaggctctgtgtagtggcaagtcagaatccagtaaggaaaataaatcattccagattcttcagaaggaagtaaatacagggaatttgttcgtgagtaacagaggagctgagaagccaataggaaatagtgaggcaaaccaggagttaggaactacaggatgctgctacttggccagaaggacaaagggaggaggtggtattactacagtccagaaactgcagccctctggaacgcataggttcatggttggattgctcagaagtggctagaatcagagaatagatacaactactacggaagacccaccacatgcagagatagagaggctaataaataccctggcttgccctctcctcccagaaccagtcttctgccagtgcctcccattagtcaaacacagtgataagatggtgagcaaaggaggctgggaaatgtggtccttgcagtgcagaacaggacagggcgggaaatggatctgagagcagacagacaaaaaactggcagagttgttagcaacttggcagagttggtaataactgccgagtccggtagaaaaaagttatcaacagttcttgcaagaatcctgtgtggcttggggcacatgagcaccccgagccaattatatggccagtggagtacagttggctgattggcttaagactggggctgagaatggggaatgggcaggaggtgaaatgcatggtggggaggtaagctgcaaatatccactcattctgaccaaatcacagagtgggctgctctctgggatgacgagagccagggacttcagtgtcagctcaatgctctttcgcttgtctgttttccttcttagttttactctccccatgaagctaggtccaaggcttaggcagcttcaggcttgtaatccttgaggagagactgcttttccttgacagcttcctaataaaaagtcttggggcagagcttgattggttgggctttggtcatgtgtccatctttgggccaattgcagggtctgcagctggggtactgtgattggctcagccagaatcacatgattacctctgtggcccagaggccagcatatgccaggagaatccctcatccagggttatgtgagttgggtggagggtgtccccaagagatgtcaggctgctgttctgggcagaccaaattcaccattcaaggtcttggtttctggcttggtgccttctccctgacctctgcttcttgactcttcaatgagcagaaagaactaagggaactggctgggcatggtggctcacacgtgtaatcccagcactttgagaggccaaggagggaggattgcttgagctcagtaatctgagaccagcctgggtaacagtgagaccccatctctatgaacaaaacaaaacaaaaacaaaaaaccaaggggtctgatatttcccccacttcccagagtgctgttgctcttctgtatatatgatgatcctttatctttcttgttgggtattagagatgtgcagtttgccagaaacaaagcagatgaggtcttggcctatttggctaaaacaattttgcactgttgaaaagtagacaaagtagaaaaagggctaaaaggaggagatgtagcatctcggaaacaggtaaacctctcttctgctggaagtctaagttggataaatatccactgtaaactggaactaagcttttgggcacattggttttagagtatttgacttgaaagtttttcttgtgtgcaaatctgtatgtgttttgtgggggctctcaggtgtgaacaagagatgacattaggatgtctgaggagattctcggcatgtgaatggggccactaggggaccttggggggtgactagcagagactagagcagaagtagggtgactttggagaggactggggtgaccgtggtgtcttggataactttgagggtgctgttgagggtgtctgggagtgaaactgaggatactaacatgagttgttatgagacaccttttaggagttcaagtagggtgaccaggggtgtctgtgggggtggttctagaaatgatcgaggctgggctcagtggctcacgcttgtaatcccagcactttgggaagccgatcacctgaggtcaggagtttgagaccagcctggccaacatggtgaaaccatgtctctactaaaaatacaaaaattaggctggcgtggcagcagctgcgtgtagtatcagctaatcgggaggctgaggcaggagaattgcttgagcccaaaggcagaggttggagtgagccgagatcacaccactgcactccagcctgggcaacagagcaagactccatcttaaaaaaaaaaaaaaaaaaagaagaagaaagaaagaaatgattgaggtgattctgtggggtaaccttgaggatgagtgggatgacctttggggggtcctctgtggggtgaccttggggggtgtgtgggattatgagagtgtctgagaattgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttggagggtgaccaagaggggtatctggggttgactctggggcccctgtccccctctccccagttctcatccatatgagcaagggcttcatgttactggccgtggccctgtgctgagtcctcctcccgcccatggccctctcctcctggccagtggtcctccgcctgaacatggccgactttgtcttcagtttcctctgcctcggcattggtaggtgttggcttggggggcgggggccctccctaaccccagccctgctctctggctttctggaggtgtatctagacttccgtgctgctcccctcggggcctctgtcttagcatgtctctggggagctctgactcagttctactctatctgtgggatgtctctctctcccccactctctgtttccctttctttttttgtcccctctctccaggtatctttctgtctgttgtgagggcgtgtgtgtgtgtgtgtgtgtgtgtgtgtgtgtgtctgcttgtcacggagggtgggagaggatgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacctgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacgctgactccgagcgcaccccgggccttcccatttcatacaccctcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatatcaggccacgccctccgaggggaccggtggcaaactccagccctcgctctagggcccgccctttgcggctttgtccctgcccactgggtcctcacagtacctccaccccagaggcccagcatcccctcccgttctgcagacacttgtccagcgtcccgctgagctcggcagtgtggctagtttgtgtggccctgcccctggtgcccagccagggtggtctgcatggaacttctttcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcagaccttccattgccccccacctccccaccagggcagggtccatcctagtgtgagtgaactgttctggcgtccctgacttgccctttgggatctgagcctttccctgcctgtttgtctgcacctgtcacagccccttcctttccccacctgctggtgacctcagacttccaggcatgagattgacacagctggggtggccccagcctcagccgagtgggtccaggtgcaccacatctggaaagataggtgatggcagaacgtgacacacattggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcaccctgggagcacaaggtgggaggggagagtgagaaaggtctacggggcccaagttctgcctggggagccccagctcgcagacagggcctccagtgcccactcccagaggaaggtgggcagggattcccacagaggggacagggtctccagtcctggccaagggggaagggacctcagggtccagctcctgcacatggggcagggtccaggtggacagtgcctgcagacaggttagggggaggaggggcaggaccatctgcaggacgctgcccctgcgggcacatcgcagaggccacctctccaggactactctctgactcgacggtaacaacacattaccacgaggaacggtgaactctggtgtggggggtgagatgcagttgtccctggatgggcgggggaaggagggggagctggggcactgatggggcgagtggctacagctagctgggaagcagtgaagcagatgcctggttagctctcagaagccagttcagaggctgagtcccctccctcagcccttccagaccctgggggcagggctgcctcaccacacaggtgtctttgccaccttccaggtgtccgacacacagcatgaagtctgtcaccttctggacgtgggcttttttgcactcatcattaggcaggattttgaggtccacacactggagatcatctggaaatgagactacgaacccgggagaaaaagggctgcagcccgacctcacctgcttccctggccctttctcccttggacgcaggagtccccatccccgccttgggctacacagtctgcccccacatacaattctctggttcgatgctgccccagccggaagccaaacaggtgctccccacttcgggttcctcggtgggcaactccacgaccttcacagcatctgtgatggtatcagcaggctctgtcaggcggagcagcatgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggcgacccagccagagctggtaattgctggggaaagatgggaatggagggatgagaagacgggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagattttgagagtgcaaaaggcaaatgaagagacagagcaaaaaagagctcaaaaggacagaggggtgaaaaaggcggaggggagggcagtgagaaacagggtgagcaaaaaagaggcagatgagaaggataaaagacagggacagcgagaaacaggcccagggaagagggaggaagagggaacagaacacggaagggagcgagaagcagacaaatgaaaaaggacgcgggacgtcagagtgagaactagaaacagaggcagagaggaagcaggagtgaccgagtgtgggagagaaaagggagggaggccctgggggagggtgggggcaggtggggagggtgggggcaggtagggaggaggggaggcctgagagcggctcagctgcagctggggctgtggtgcgggctccccaggggcaggtggcctggcctgaagtccaaggtcgaggcccccttcccttcccagcaccctcccgcgcgtttctcgccccgcctcctccttcctcctccctcagttgccccacccagctcccgctgaaaccagcccttccctgtgtctctccagagtggagggatatcctgtggggcggggagctggacagagggagaggcgccccctcccaggcacacaagttggggataaagcccttcctttactctggggcctcccttaggtccatctgggtgtgtgtttagtagggatgagggagcggtgaggtagagacccagagagagagagatgggtagagagatggagggtgagacacagtgacagagatgccgcagagagactcagagacagacagagacaggggagatgcagagacaaggagacagaggagagagaggaagacagagaccagaacacagtcacacagagacacaagcagaaccagatcccaagagacccaggcagccttggagaggggtgtccagcccagctctgccctgccaggcgacctgcgccagagccttcctctctgcctcagccccccagtcttgcctgaggttatccaaggggaatgccactggcctgtcaatcctgtggcagcatagatgccctcctcccagaccccaggcccctactcactcgctgatgcaatgagcagctgtgagcacccactggcggtgcaccaggatgcccccacactggaaagtgctgaaatggtacagagccgcctgccagggctgggaatgctgctcacactcccagcctcccacaatccgggactgaatcgggggcgcagcacctgcagaggcggtgctgggtcaggaagggcagggttggcaggagaggccagggacaaggctaggagagggagctgggctgtgggtctgaagggacattgcgggtagaggaccagggctggaggttggggacatgggcaaggggtgttgggaaggggtgggactctggactgttccctgggcttttggagtggtggctggacctggtggggagattttgtgctctgacagtagagcagcctccagggatcagggtaggagacaggagacagtgtctggagcagacactgcatctgggcgtcaggtcatttggggtctggggctgggggatgggaggtggtgggttaggggagtggaaagggattctggaaaccagggatcaaggcgccaagggtgggacaggatcagaggctcactgaggaagaatctggagggctaaggggctcctaggctagggaaacaggacctgggttgggcttttgaggttcaggaaaggatgcagctttagggaaccaggtctgagaggtaaagaagagcatctggactgaagagtttgggggtgacttggggtccctacattggggttggaaggggccagcttggctgggacagttagatttcagggcttcctggttaaagggtaaaagaaagggctatggttaaggctagaggtgggcttccgagaggttttggggtccttcctgtgaaccaggaatggcaatctgaggggaggttggggccctgagaacacagttgcggtcaggactgggacggggctcaggaggagggaggcgtgagtggcagtccttctcggacagggtgaaggatgggatcttcgtttctcatggggatggggttcatggtctgagggtactggaaggatatggggtcctcttggaggcaatcctaggaagaggattggagaagtggtgagaacaggcgccaagcagctgtgggaatgcaatgcaggacccacttgacgtgaggttgtagaatcacatactgacttgggggaggccagggcagaagcgctggctgagaaggcattcaggatccttggggtggggttccagaaaaccagagctgtgtaggaacaattcaggcagagaagggctggggcctggggcgggatggaacttccccaaggaaaggagcatgtggtgggagggtgtggtgtttttcctgggagagctgggggtgctgggtgggaagggacatttgcagacccccccccataccagatgggggatcccacatgccagtttgggaagcagggttttctggtgaaatttgggggaccctggaaggactggggagaccagatgtcagggtctggaggacacagttgagagcggacagctggatggaaaaagtcactggagtgtggtgggatttgtagactcaggagccaaataggtggccgcagggaactagggggcaggaggggatgatcagagtcctgtggggtgggggaagcccatgggagggttggggtcctccagagagagacagagatggcccagaatctgcccctttggtaaagcggtgggacagggcgttggctagggaagaggagaaagtactgaggcttcctgggaggagcaggaatctggtgtgggagtgagcactatgacaacatggaggagcgggggtggaagtttagggtggggccgcgcaagatagataagagccggggcaccccggactaggatagactgtgggccagagggatgagggtggggtgttggaggggaaggtcttatcggggggggatgtgaggccagcaagagaatcagggcccgttccccctcccacatccccccactgtctcaccagtcccccccagggacagggcgaggcacagaaccaggaaccacatggtgacagaggtgtccaggggccagcaggtggaggaactggggaacctccctggggaggcttttaaaagcccttatcccctcagagccccacccctgccctgctggcacccagatgttggccaaggcccttcccctgttgcctgggggctggacaattgccccccccccctccgatccccagagctgtagacggggagggagaaccagcacctgttctgcaggccctggatcacgctggacgcattcctggggttgaagccaggtggggcagggcctgtggctctggggctttgctctggggagcagccagtgaggcaaggggggactgaggggaagcagaaacaggaagacggaggaatcagtgacccctggtacaaagccccatatacctcagtctcaattaaggccctgcacccccagacctggtgccctcaaacaccagcagttagggctctgattccctgcaccactcggagccaagatactagcatctcagctgccagttccccctgaaatataagccttggccttcagaatgccctggttcttgcactcccagacccaggacctaggtccccaaagctactgttcctttcataataaaattttggggtacacatcaccacattcctagtgcctccagatccaggaatgtgaagtttcaggggtctcccagggtaagttctttagcattacaaaatccagtgtccctcccaaacaatgctggggtctcaatgagcctcccacttcttgctcccagttatgggtgctcaacgtcctgtcctccaaagtcccagagatctggacaaccttccctcccaggtcaagatcaggctaaccacagattccaatgacccttcccccccaccaccagtacaatatttaggtctcacgagccaggttcatgtacttcaacattcagcgaccttgaacatcacattttgtggtctctgaagataattaggaactagattcctgcagcctcaatggtaaacccataggcttccaacaggttgtcttggctttttggtaaaatcaaagcagctcagagttccagcctctgctgtatatcagggacctggctaaggaaaggacagtatttgcctttttgccatggctaccaggaagcccagaactaaatctttttttttttttttttttttctgagatggagtcttgctctgtcaccaggctggagtgcagtggcgcgatctcggctcactgcaactcctgcctcctaagttcaagcgatcctcccacatcaccctcccaagtagctaggattacagtcgtgtgccaccacgcccggctaaatttttttagtatttttagtagagatggggtttcaccatgttggccaggctggtcttgcactcctgacctcaagtgagccgcccgccttggcctcccaaagtgctgggattacaggtgtgagccaccatgcccggcccagaactaaaccttaaagaaaaagccattcttggtaatctagtgtctgttaggtcctttaactgggatccagagatagagggtatttactcagtgccagacacgattttaatcagttcagacgaatcatctcatttaatcctcacaacagccctttgaagtcagcaataagatggtctcattttacagataaggaaaccaaggcgaagtgagattgggcctcttgttcaagatcacacgggtggtcatgtgtgttgaatgaatggagccctgcttcaagccgcttctcctcacctagggatcggggtggtgggtgaaaaggaacagtgtacagtgtctcggggtttctctttgaccccagaaaaaagtcacagaaattcctacagagcaacttggatcagcgctttgttatcttggcattaaacaggtgaccttgagcgccagctttgtcctcaggtgggacaagtccttggctaacatctgggccttggacagggtcttgggggatggctccgttctgttccatgtcaggcggggctgctggccagctgtgggggcttctgctcagtcaggggcacaggagataggctagaatagtcagttcctcttcatggtttccctgatccactccaagtagtggcagactttggtatagacaccaggcttggtggtgttgtcacaagggacgtcaccccaggacacaatgccctgcaggatgcccccacagaccaggggtcccccagagtcaccctgtggggaaaagagggggtctcaggttgagtgaaacctcctggattcatcctcatcctaatcaccatttgcaatctcaccccaaacccaatccatccccatcccagggaaccccaacccaactcaactcaatacagcccagtttatcccaaacagagccaacccaaccccaaccccaaccccaattcaacacagctcaatacaactcacccaacctatatccaatctcacccccatgcaactccagtgcaactgtactaagttaaatccaactcagcccacatcctcaccattcaaaatcaaatcaaacccatgcccatctcaaaatccaatctcaatcttcatgtcttctgcattccaaacaaaatctacctcatcccaattcaaccctgacgtatttcccacccagaatcaaaccaaaccattcccattctcaaccccaacccatgccatctcaaactaactatcacattatccacctcaaacaacgcaatccccacctataaccccaactccaacctcacccctattctaacttctcttcctactccatctccaagcctaaccctagcatcttctctggcccaaagcaaagaaaatccaaccccatccggactcccacacctgtccccatccctcttcttccgcctgatggcccctctaggctctgacctcacaggattctgcgcctctgccctccgcgcctgcacacaccatggtgtttgtcaggcgccctgggtagctcttgtcacaagatgtgtccgagataatgctgatgttggcacaatgcaacgtatctgggagactcactggggaagacagtggacttggagcagatccataaattccggcccttgtcccctccgcccaagagccctggagcataggattccttgaggcctcgcatccagctccatcctttcacgcaccttgtgaccgggggctcccagcggtcccaggctcgttgtgggacaccaggccccagccagacaccacacaggcctcccccgggtgggggcaacgcgtgggtagcaccgcggggcgcacctgggggttcaggcgtgcgggctggactaggcgcagcaacatgatgtcgttgcggtggctgcgcgcttcgtagcgcgggtgtggaatgacccgagacgtggtccgtagttgctctgggccatcgcgcttgcgcaggttgtgctctcccaggcgcactctcatgaagctgtgcgggcgagtggttttcccgccagtggagtgcgggccagtggttacccgcaagtagaggacagaaagatcaaagagtgggcaacccgaggtctcccgaccctttagaaatctcgacatcccattaccttttcccaagaccctgaagccaatggttccagcccctgctcctcaaggaccaacgagtctgaagtcaggcacactcctagaactcgatcccctccaactactcccagccccctcctggtctgtccccgaatccaggattctcacatccctagaactgaggctcaaaagctggaactagtcttctccttcctccttcagagatcgaaggctttgaaacacacactccttcctaacccaggggcttgacatccggcctcctcgtctttcagaacccaggagttctggcgtctgcctccgtcttcccccaaatctaggagctcttccccccgaaccaggctccctcaggaccctgagcccctgccttcataccggctttggcagtgggccgcagacagcacccagtgtggggagatgagggaagcgccacagttaaagcgtccacgctcgtagagagccacttgccatggctgggagtggggtgcacactcgtcaccttccagcaacttgtcaccatcctgggctgctaagagaaggggtagaggatgcctgaggacagggacgtttacattgcctcctacaccttccttgcaccctgccctaactactatatgcctatgcctttcccctaacttctcaagacaccctgccctgtttttgtttgttgttgttgttgtttttgagacggagtctcactcttttgcccaggctggagtgcagtggcatgatctcagctcactgcaacttccgcctcctgggttcaagtgatcctcctgcctcagcctcccgagtagctgaggtgcccgccaccacacctggctaatttttgtatttttagtagagacgaggtctcaccatgttagccagggtagtctcaaacttctgacttcaaatgctctgcccgcctcagcctcccaaagtgctgggattacaggtgtgagccaccatgctccgcctgccctgttgtttatttacaaccgctgcctgttttctccagaactctagcccccaccccatttgctataagactctgggagagagaggaaggggaacagaccagagggcaagaagtcctctgtggttgggggtggagacaggggcactggatacaggttcagacaggtggtcacttgaaaccagtcattcacggtcaccaaattgtcacagacgtcaaacgcatgtggccactcagtatgtgtgacccagccttggccccagagtctggacatgtcagccaaattcagtgtgcagtatgagtcccagatgtggctatacaaggtcatggacatgcatacatgcacatccagcttccacacttaggtacagctatggacaggactggaagctgaaattcacttgcatgcacatgggttgcagcttcaagaatcacagcacaggctgggcacggtggctcatgcctgtaatcccagcactttgggaggccgaggcgggtggatcacctgaggtcaggagttcgagaccagcctggccaatatggggaaaccctgtctctaacaaaaatacaaaaaattagctgggcatggtggcgggtgcctgtaatcccagctactctggaggctgaggcaggaaaatcgcttgaacccgggaggcggagattgcagtgagcggaggttgctccattgcactccagcctgggtgacaagagtgaaactccatctcaaaaaaaaaaaaaaaaaaaaaaaaagaatcacagcacagatgttcatatgtgtatatgaatatggatggttaagacatgaatacatacacacacacacatgcacacacaaacacacacacagaattggatattgttcagacctaaattcaacatctctagtgtgagtcttggcatccagtgtcacagacacttgcatacagggtctggacaaagatgggtccttaagcctgggttcgaatgtactagctgtgaaactttgagtaagttattcgacctgtctgtgcctctgtttcctcatctgtaaaatgaagattgttgtaaggatgaggtaggaatgtgtatgtgtgtgtgtgcatgtgtgtatgtatggtgagtgatacctagccctggtagctacttaataatattagttgttttttgcaaatgacacctggatttagtcacagggacatacgtgtgaaagttcaggtccatcctggagatggccaacataagtcagacatctgcacagaattacctataataaatagtcaaggttggccaggtgtggtggctcacgcctgtaatcccagcactttgggaggccaaggccgaggtgggtggatcacctgaggtcaggagtttgagaccagcctggccaacatcgtgaaatcccgtctctactaaaaaataaataaataaataaataaaaatacaaaaatcagctgggcgtggtggtgcgtgcctgtaattctagctactcgggaggcagagacagaattgcttgaacctgggaggcggaggttgcagtgagctgaggttgcaccactgaactccagcttgggcggcagagcgagactccgtctcaaaaaaaaccaaacaaacaaaaaaaagtcaaggttaaaaccgtgattcacccacaagacattttgtagagttagagctgcagacaccaacccagaaggccaacactcagatgtggacttgctgtctggggcagcacccagacacggggctgggcattcaaggtcaaagacatgcagctgaagccagaggcagccagggcaggacatatttatccatctctagatcagcccccaagccagatctgtggagtcactgattgggtttcacatatggggatctggctcatgcatgtggagaggatgtgaacatacagggccttgtatacccactgcacacgtgcatgtacacacacacacacacacacacacacagaatggcattatgcttaaggacatgattagagacattcaaggtcacaggaccaggacccctctccactgggcaatgtggatgcatcccctgaaggttgaagccatgcacactcccacccacacaggggcaggatttgcacagccagaccaaatgcccacactctccccatcacagtcaggaactgggccaaaggcccccgtgagaccaggggaatgcggatgtggtggacaaggggcttaacaaaggaagggtgaggtcgtcctccgaagggcggagggtacgggctgaacagctgggcaccgaggctgcacctggccagtccaagccagaggaaggtggaggccccagctgggcgcagcaggcaggcgcgaggcaggtaggtgagtgcacagagagagccggaggggaggctggaggcgtgggggtctcaggggcccccaggagtgagggtcatttgtggcagaacgttaatgaaagtccaccccccaatttctccagaagagaggcatcaggttacaattaatttcttggtgtgtggcagctgagttcaatctggagtttgcctgacacccaaggtgaccttgatgttgtggccgtccctctgagccacagccccttcccttgtcaaatgaggtcggtggtgcccaccacacatagacgttgtatgtaagctctaagcaccgtgcctggcttgcacacctgaaggggcactacctgggccaggcttatgcttctgcctcacacacaaccacatttaatcccctcaaagaccctgtaagagacagggagtggcaggtgtgggactcaagctggagtctgtctgtgctgttggcctctcagcacttgtctaatgcttgctatgtatattacctctgttatgctattgagacctcactgttattgtctcaagtgggtgctgtcttatagagaaggcattcgaagcccagagaggtgaagcagttccctcaaggacacacagcaaggaagcggttgccccaggactcagctcaggtttgtgtaaccccaggaccgtgttccttgtcgtgggcagcgagaggccccaggcaacatagcgactccagagcagcagcaccagcacctgacggtaagggcttagggacattggcacaggtggagggtgaaggaaggatctttagtggtctctgggtgaggtaggggctggcagatcactgggcccagacatgcttgggaagggggcacctgctcccacagacctggccccctcctggggccacctcacctgtggatgccagcaggaaggagagagtgaggagaagccacattgtggaggagggaccagggttcggctgcagtctggggagggagtgagagaatccaggtgaggcaggacccttctgcctccaccaggatccctccagacacagacttatcccatccactgttaataaatttcttctgaccaccggtatccccttcccccaaccccactctgcgcttccttctgggtcccccatctctggaaggtttactcttcctctaggcactcggacagaccctgccccacctcctccacctgtcagcctccagcaccatgctaccagcccctggatctctctccatcatcaccaaggacccctgtcccaacttttttttttttttgagacggagtctcactctgtcacccaggctggagtgcagtggcacaatgtcggctcactgcaagctccacctcccaggttcacaccattctcccgcctcagcctcccgagtagctgggactacaggcgcccaccaccgtgcccggctaattttttggaaattttttttttttaagtagagacagggtttcaccgtgttagccaggatggcctcaatctcttgacttcatgatccacccacctcggcctcccaaagtgctgggattacaggcatgagccaccgcgcctggtctatctcaaccctcttatctggccttttgggtccccctccagtccagtcccctccaccagcttgccctccagccatgaccccaaagggtctttctacatctggagctggctgtgcccctcccctgctcaccaccctccatggatccttggcaccaccaggataaagtccagctcttcaaattcactttctttctttttttttcttttttttttttttttttgagacggagtctggctctgtagcccaggttggagtggagtggcgtgatctccgctcactgtaacctctgccttctgggttcaagagattctcctgcctcagcctcccaagcaattgggattacaggtgtgtgccaccacgcccagctaatttttgtaattttagtagagacggagtttcaccatgttggccaggctggtcttgaactcctgacctctagtgatccacccgcctcagcctcccaaagtgctgggattacaggcatgagttgcctggctccagcctcactttcaaggacaaaagtggcttcttcccttccagcccctctccctgggtctcccatgaccttgtcctagacgcagccagtgctgccattttccctcctgccatttcatgcttaggctattcctcccaccgcatatccaacgccattcccttccagccccgcttcctccttgaggccttctctgacctcccctgaccctcagtggtgtctgcctcccctacgagactggcagctccccgaggagctggtctgactccactctgggtctccagtactgcagggcccgacccacgggaggcctcaggaagctttgagggtgaattgaaatccttcttccccatatcttccaaattcatctttgtcctctgacactctgcccccacctcttctgggaggccccaacacctaacaggtgtctcccctgaatcccacagcacccattctgtctccattacagcgcagatgccccatacttgctgaggtctggcctgttcttttctccatctgggggtcttgaagatggggctcaggtcaggttctttctgtgacctcagcactgccccacctggggcctggtacacaggaggcctccgggaggttgtgctgaactgacttgaacccgtgatcactcctgaccacgttcttggctctgatacaagtacttcagggacgtcctcctgatccactccatccccctccctccccaccactgcagctccttctggccattccaggacattttcttggttcaggttcaatttggggcattggtaaaggacacgtggatctacccatgcccttgacactcagttctccaagcgtggtcaacgtttccccttgaaaccagggcacagtgaatctcccctttgcccctccctcagtcttgtctcaaagctctcacctcctccagatcctccagcagcatctagggcagcttgggtgccagaagggagcaggtaccaggatgcctgaatttataagctcccagtcccagctgggtctgggggtgtggtggtgtagggtggggtgggaggtggctgagagtcaggtttacaggcagagacgccttggttgctggtggggtgggagacttggcctaatgagcatttattaggttgaagctgttgtctgagtccacaaagaggaattctccaccaggagc

SEQ ID NO: 1123 - DNA, 25757 bp, Homo sapiens
gtggaggttgcagtgagccgagactggtcactgcactccagcctgggagacagagcaagactccgtctcaaaaaaaaaaaaaaaaaaaaaaaaaaaaaaaaaaaaaagaaaggaaggaagagaaacagaaagatgcatgcagagagccaagagataagaggagatgcatatataactccctagcactttgggaggctgaggcgggcggatcacaaggtcaagagattgagaccatcctggccaacatggtgaaactccgtctctactgaaaatacaaaaaatcagctgggcatgctgttgcacacctgtagtcccagctactcgggaggctgaggcaggaggatcacttaaaacccaggaggtggaggttgcagtgagccgagatcacaccactgcactccagcctgggcaacaagagcaagactcagtctcttaaaaaaaaaaaaaaaagaaatagaaaaagacccagacctcaaggggtggaatgaaggcagtgagataaaaggaaagagatttgcaggaagatggtcactgatggagacagagacatagacagagataccagatacagtgtagtcagtatagatgtggatatggatatataatacacatgtgcatctatataagacatgggtgcaggctccgatgcatcaagggatatgataaacagaattggtaaacagaagtcggggacgggggctgtgcagggagacaggagccatttgggtccattggagtgaatcagagaacttatcttggctgaagggggcagcctccattgactcagcccaatgcttgctattttgggaatgtgagttcttcaaactttttcaggtgaatccagaaacctggcttttgtataaaactttccaagttttagatattggcagcaacaaattcagactgtttttccaatccactgacccaatttggctaatgggtcagtgatccgtgactctgagagacatggtcttattcccattctaagatgaacgcatttcacatttaaacatctctgggccaggtacagtggctcacacttgtaatctcagcactttgggaggccaggagtttgagactagcctggacaacatagcaagacctcatctttgctaaaaataataaaaatttttagcataaggcttaagttaaaggaggtcccatcatggagcaatgcatgatgggaaattcccacccagcatcttttaccagaatcagtgctttattcatggagggaagaaaattggaacagtatggatggtcacttttcagaggcaatggagagaggattcctgcatcaggtggattccaggatactattagaatgcccagaatctaagattctagaattctcagattctgacacactagtatccatgattctagaatctagaggctcaacgtttagagttttatgaatccaagattctaacattccagattcccctggatcaaaaaactccaggattctaacattatctgaattaaatctaagatatgactagatttaaaaaagactagaattttggctgggtgcagtggctcatgcctgttttcccagcactttgggagtccaaggcgggcagatcaccaggtcaggaatttgagaccagcctggccaatatggtgaaacctctgtctctactaaaaatacaaaaaaaaagataataataataataataataaataataaaaaaatgaccccggtgtgggatgtggtggtgcatatctgtaatcccagctacttgggaggttgaggcgagaggatcacttgagcccaggagttcaaagctgcaatgagccgtgatcacaccgctgcactccagcctgagcaacaaagcgagaccctgtctcaaaaacaaacaaacaaacaaacaaacaaacactctgaaattagaatgtgtcttccagaaaatggtgttatataatcaatgggatctaatgggatctttcctcctcctcctttttttcttctcctcctcctccttcttccacttcttcgcagttcatgaaataatggcacatcttaaaaatgctagcatcttatatttggttaaatatatcgattggcagatagatagactgacagagagagagaggagagagaaaaggagaagacagagatgaaaaggcagagacagaggggtgagggagcaagtttcagagagagttctgggccaggtcatacccttggggctggacacggccccccagcctgagatgagacactgcatgcctggggagacacaggtctggctgaggttgaggggctgcacagcaggactcagacgtgcctgcctgggcaggcggatcagcatgatgtcatcattgtggtcattggcgctgaggtccttgttgaagccagggtgggggaagaagtccgtaacccggaacagctgctccggaccctcccatttccagaggtggtgctctccaaggcggacccacagatacctgctgggacaggcctcagaggtcaagctgggggaaaggtaaaagtcctttcagccccagccctcttttcctgtccatcagggtgctgtgtgaccctctgcaagccacacaccctctctgcaccctcatcatctatgtctggcccagggtactgtgattttaagcgaggcacacacctcctctgggtccctggtccccactctgatgttttgtgtgtctccatctttgtagctctccccacaaagcccccgctcctagtcccaggctgagtgagccaccttcctccctactcacctggagccttggtggtgacttgggtccctaggaacggtgtgggcacgggggaccccacctaccacataacaaccgccccacccctgcccccacaggtctggtggcttctgtgggagcggctctgtatgtctaagtggtgtgtgtgtatacgtgtgcgtgtgtatgaaaggggatgggatatggaaaatccccaaattgggggtcatctctggcctcagcttttcctgtctatcatatccttcacccttcaatgcatgtcttcctggtgtctaaccttaagccctcaccacagtctcagcgcacttgtttcatttctggtccatgccctagacagctgggatcctttcggggatgacaagtccattccccagcctctgacctctgacattaggcagcaggctaatgactgcgaattcagggttggggaaccagaaacatctgtgtctgtctctctctgtcattcttgctgtcttggctctggatctggaaaagtagtcctcacccctacatcccttcatccccctacccttcccctgcctctcactctcttccaccttcatatctctgcatttctcctgcttcactttcggctgaaatctgaacatcgttctcccagtctgatgtataggcttaagttaaaggaggttccatcatggagcaatgcatgatgggaaattcccacacagcatctcttaccacaatcagtgctttactcatggagggaagaaaattggaacagtatggatggtcacttttcagaggcaatggagagaggattcctgcatcaggtggattccaggatactattagaatgcccagaacctaagattctagaattctcagattccgacacactattatccatgattctagaatctagaggctcaaggtttagagttttatgaatccaagattctaacattccagattcccctggatcaaaaaaactccaggattctaacattatctgaattaaatctaagatttgaacatagaattttaatgttctaggacaaaaagactagaattttggctgggcgcggtggctcacgcctgtaatcccagcactttgggaggccgaggcgggcagatcacaaggtcaggagttcaagaccagcctggccaatatggtgaaacccccgtctctactaaaaaaaaaaaaaaaaaaaaaatagcctggcatggtggtgcatacctgtaatcccagctactcaggaggctgaggcaggagaattgcttgaacccgagaggcagaggttgcagtgagctgagattgtgccactgcactccagcctgggagatagagggagactctgtctcaaaaaaaaaaaaaaaaaaaaaaaagaaagactagaatgtcatcattctataaatctataaccttagaaatttaagagtctgggattcaaatagtttaagactacagaattatctgaatctcaatattctaggatactgtgaatcaaagattctagtactgtgagtttcaatattcaatgaatctagaaagctctgaatttaagattctaggatcacactagccattatggctattgaacacttgaaatgtggctagtccattttgtaacaggctatgtgtgtaaaatacagaacagatttcaaaggcttagtaccaaaacaaaagtaaactgtatcgttcatacgtatttaaaaattgattacatgtcaaaataagtttttgggtatgtcaagttaaatctattagaattaattttactcattccttattttttaaatgtgtccaccagaaatttaaacttacacatgtggctggcatcataattcctctgggcagtgctgacccagactgctaagattctaatagtctgcgaatctatgattctaaaatttgctgaggctattgcagaatttcataaattcaagattttaggattctacgattctggatttctctgggtcagtctcggattcgaagagcctaagtttcgaatcttagacttctcaaatgagatattgctggtctctagaattttaggatttgggaggctacccttcctacttctaagagttgaacttgtggtatcagaagtggaggctccgcacttctggcctaaagcacccctcaccctctcctgacccccagcctctgtccctccccagcatggccagcctgggtcactcacggcttgcggcagtgggcagctgtgagcagccagcggtcactgatgagggtcgccccacagaagagccgagtaaggtggaagaggccggcctgccaaggctgggagttggggcgacattcctcggccccgatggcacgggtgtctgcccagccatgccctggggtggggatgagggacaaaggggtcagcgaagagcaggctgggagggcagggagaggatgctgagaagcctagagggcaggaggcagaagcctgggatgggagggaagagcaaggtgaccttagtacagccgtgaaggggcagccagcctgggagcctcacctgccagcagagagagcagagcacagaggagtcccagcttcatgacccctgggcacctggatcctggaacgtgcacccggcgtccagtgcttctttatggtaagccatgccatctccttcctcctccatggggccgcccctgtgattaatcggggttgggaaatgtacctgggggagggggaagccctggggctgtgacaggggccttgggagaggaggtaagtgcagggggaccccccttttgggatgaactggcggcttgctgggccagagcttgactgaatggaggaggagtgctgggggtgtggagaggttgtgggcacctcctctggggtcttcagagtgggagacctcattcctcatcaccttaggctacaagatacagaatcttttgtgtcctggaaaaggagggagatccttgaagcctaaggtcctggggtgcagcaggtttattttggataaagcagtggtgtgcagagaccaacctcccacggcaggctggagggatgtgcagggggaccacccagaaaggaggcgaggggtggaagacagagtcaggactcagacacaagagcaaaagatacaaagagagggaggtacaggcacagaaggacccaagatgagaggaggagtgggaggaggagacagaacacgggaaagattgagggaaatccaggtggagtgaggcagagaccacaggcagctgcacaggtttacacaccttgcagaaccttccctgccctggggatttgggcctcttcccacaaggacaaggccctctcctagaatgttgagaaatctggttccatctggattaacccactcttgtcataacctgcccccttccccacggctccaccacccaaggacccaggtgcccaaccttccaggtagcaagtgccctgtgctctctcttaatacatcctgatctttgccaaatcctgagaacatttgctatatatttttttcatccatctccctgccccccaccccattgtcccttccatcaccccatcctccctgcctctctcctcatcattccttctcaccaggtggacagcttctggagggctgggcccaggtctgactcatctctgtgtcccagcatcaccccgttccaggcggaacagggcttgcagaagtcctcaggagatgttcattgaatgagtgaatgtctttctccatatccttcttttcctggtgaactcccactcatccttcaacacccaacctcaattctccctcctccaggaaatctctgagatcctcaggcagagtccatctttgcctcccctgggcacttacgatcccttccactttctcctgctcacaggcctggttatgaagctgggtctgggctccccttgaatgttctctcactgtgtcgtcatggtttggagcatggactctggaactgaaccatgtgtgtccaaatctcaatgattaggtgtgattagtgatgaggtgtgtgactttgggcaagtcacaagacctctctcagttgctccatctgttttttgtttgtttgtttgtttgtttgttttccaaaacggagtattgctctgacacccaggctgaagtacagtggcgcgatctcagctcactgcaacctctgcctcctgggttcaagcaattctcctgcctcgacctcccaagtagctgggactaaaggcgtgcgccaagacacctggctaatttctgtacttttagtagagacggggtttcaccatgttggccagtctggtctccaactcttgacttcgtgatccgcctgcctcagcctcccaaagtgctgggattacaggcgtgagccaccgcacctggcctgctccatctgttaagtagcagtaataacgagggtcgttggggggattaagcaaatttacacacatgaagcacaacagtgtctgacacatggtaaatgttcaatgtctcttcatcccctgcagaaacctgtggtgcctttatcatagctcatttcacccttgcctgcagttgtctcactccctttccagacagggaagtccttgagatcagggactgggtatccactatgtgctaagtgccaccttaactgctattaagagcattttagaccaagcgcggtggctcacgcctgtaatctcagcactttgggggaccgaggtgggtggatcacttgaggtcaggagttcaagaccagcctggccaacatggtgaaactctgactctattaaaaacacaaaaattagccaggcatggtggcgggcggcctgtaatcccagctactcgggaggctgaggcaggagaattgcttgaacccgggaggcagaggttgcagtgagcctagatcgtgccactgcactccagcctgggcaacagagcaagactctcaaaagaaaaataaaaaaaaaatgagcattttaatagctacctttattgactgtgttctcagtgcctggtgttaggtgaactttgcatgtatattatctcatttaattatccttttgttgttgttgttttttgttttttgacacagggtctctgttgccaaggctggagtgcagcggcatgatcatagttcattgcagcctcaacctcctggactcaagtattcctcctgcctcagcctcctgagtagctaggactacaaggtgtgcaccaccatgcaaggctaattttttttttttttttttttttttttttagtagagacgaggtttcactatgttgctcaggctgatcttaaactcctgagctcaagcattccacccatctcagcctcctaaagttctgggattataggagtgagccactgcgcccagcctatctcatttaactctcacgggagtctaattaagcaggtgtctccatttcacagagtgaaaactgaggaagagacagcattcaagtaatttgctcaaagtcatacagcaaagtgattgaaatgcatttccttctctacctggtgaactcctacttatcctttaaactcctgcacaaatgtcccctcattgagaagcctttcctgactccttcaggcacagcctgtggacttggtgtggtgcaccccatacccccttctgttacagcactgatctatttgtgttatgtgttcacacagcaacgggggtgacttctgtgtgccgggcacaatacaggagcttagaaaatcacagtgaacaaatatctgaatcactgccctcacggaatttgtggggaagggtgacatagaccattatcaagtaaacacaaatgagataatttcaggtataataggtgctattaaaaaaaaaaacaaacaaacaaaaaacagagcatcgggactggatgaccaaaagtggactcctatagcctgggcaattcaggaaggcctcccggaggaggtgacttttgagtggagacctgaatgacaggaatgtaagactggcctgtctccctgacctaactagcagctccttgagggtagtgcctggtctgattcatctttgaggcctggcataagacgtggctcgataaacattgtggagtgactaaagggacgggtgagttgcctttaataatgaatcgagttttcaagtttccaccgacctcgcttctggtctttggatgacaaacccagctgatacgcctgtctgacatttcctgcgtgtgctaatgggggcagaatgggaaagaggccacggaagggagctgtgtgctcagaccttgtacatcaacctcctgtgggctctgcagggtgggggaccttgtgatcacccctacgtatgtccccagcacccagcactgggcctggcacataatagatgctccataaattggtaactgaaaggacaaacaaacaaacaaaaaccccgtgcttaatgggaaatttctgttgtgcctatattcagctagcttatgttactgcttcaaagttcaggataagctgagacactcaaacttcttctttttttgagatggagttttgctcttttgtccaggctggatggagtgcaatggtgcaatcttggctcactgcaacctctgccccccgggttcaagtgattcttctgcctcagcctcccaagtagatgggattataggtgcctgccaccatgcctggctagtttttgtattttcagtagagatgggatttcaccattttggccagactggtctcgaacacctgacctcagatgatctgctttcctcggcctcccaaagtgctaggattacaggcgtgagccaccacacccagcggacactgaagcttctattagccttacctggattctgtgtattaactccccttccctcccccaatttcagggagaatcaaacaattcctcctcccaagttttcaggacgaaaatctcacagccaattaataacagacaaaccaaagattttcccctaaatgtcagagggaggtttcttggcacaagctgggcagttgaggtggcaagggtttcccaatcttcactaccccctcggccctctggtcttagaggctgggatagaagcaaggtgaggtcccttgagttcagtggcctcatgaaggcagagaaggtgctaatgactcagggccagcctagctcggaggaactggtgttgggtggaaccagaagtgggaaacagtgggagatgagaaggaagtggttaaaaggtgtttcctgggacttggaactagggtgaggaaaatgattcttccatcatccctaagggttggggatggaaggttgggactgggggctaccctgtgcacttcttccctggacacacgctttcaccgggacgtggtcagatcacgacaacaggtaacctttagtcagaactcaccacccactgtgttaagccttacatgacaatcaccatgaagatttacatacacatgttatatcatagtctcctcacaacatgtctaagaggtaggcacgtcattgttcccattttgcagatgaggaaactgaggttcagagagggcacttggcttgcccaaagtcacacagcagggagtggcagaggaagtcaggttgggtgaccccagtaactgctctcagaggctgggtgatgaccggcttcctggcttctctggaataaacctttgccaccacttcctgcatttcagcttcagtacaggcagagaatggggataggtgggggaatgaggtgagaggggagatgtttagaggtgtggagggcggcagaggtttgaacagtgcagacaaggggagagttcagccgactggggaggaagaggatggacgatggagcctctgggcatctggatcagcaggagcataacatctggatcagctggagcgtagcatctggatcagttggagcgtatgactttattgatccaggacatgtatttgcagatctgggtgtagacagctggatgctgggcagagccacaggggtaaacaccccacgagaggatgccttggagggtctcgtcacagaccagggggcctccagagtcactctgggggtggcaggaaggagagatcaaataaatgtgccaacgtgagagctgtcactttgggatctggggcagtggtggggaaggaaggagttgggttgggataaagacgaggatgggatggggttggaattaggtatgagctggaaggtaggaatggaggtggacttcaggttatgggaggttgggctgggggatgagaatgaaggcacagtgagactggggttgggattgtagttcatggaaggtgaggggatgaaaatgggcttggagatgggaatggggtggggttgggatggaaatgggattgaggatagggatgaggagggggttaggtctgggtaagagttggggtcaaggatgggtttgggaatggagttggggatcgggcacagggtctgctcttttcccataacctccctgtcctccctcccaggagtcagagactctccctgttcagaccctacctggcaagggtcctggccccggtccagtccagcacatatcatgttgttggtgaccacgccagggtagaagacctcacactctttagggctcaggatagtgatgctggagcaggtcaggcccttgttgtacttcactgaagggagaatatgccagtaatccctgggtccagcccccaatccttggggagccaggagtccagatacaagaccgtttctatcctaagccccagcccctcctccttcagactcaagaatcctggccccagcccctccccacttagacccaggagtccaggcccccagcccctcctcccctcagactcacagacccaggcatctaggaccccagcccgtcctccctcagatccaggaatccagtccccagcccatccttcctcagacccaggggttcaggccctcagccccctcctcctgaggttccggcctcagagccccagctcttgcctctccgggcggccgtggtgccccagccagcaacctggcactggtctccgggctgagcacagcggtagggaagctgcagggcccggacgcggggccccagcactacgggcctggccagcttcagcaacatgagatcgtgctcatccgttcgccttggcaggatggggcctgagccctggtggtacttgggatggacaacagagcgagtggtccggcggagctgctctccctgaagaagcagcaggtggtcatcccctactcgagcccacagtggcctgggggaaggaagaggcatgtgaaggcaaacccttcatagggactgggaaagcaggtgggcagtgacgcagggcctggagataggaagagtctgagggaagagggccttgtgggagaaggggacctcagtggacatggggaggaggaatcagttgtttgagctctgaggatctgtaggaattgaggagggctgggggcctggacacctaggtaagccttccacattttcttttctctttttcttttctttgttgaaacagagtttcgctcttgtcacccaggctagaatgcaatggcgcaatctcggctcactgcaacctccacctcccaggttcaagcagttctcctgcctcagcctccttcctgagtagctgggattacaggcacccaccaccacacccagcctttttttttttttaatttttttaaaattttttattttttattttattttatttttagttgagaagtggtttcaccatgttggccaggctggtcttgaactcctgacctcaggtgatccacccgccttggcctcccaaagtgctgggattacaggcgtgagccaccgagcccagcccaactccacattttctctgtggtaatacccaacccttcctccttcaacggggactcacgaagtgaaccttttcctttagttctaaattcctgaccacaccggaccctggcttctatccgttgcaggcaaccacctcctcctagagctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggagccataggcttcggggtccaagcgcgtgtcgttttgggggagcagcgccgcctctgcggctggagaaagaaaggggacggaatcaaagcacggagggcagggtctgggtttggggttggagctgggctgtggcactggactgcgttcggggacgggggacgcagccagaacgcgagggtggtagggaaatattgggggtttcgcgtgcaccgaagggaatgggaggagaagaagcgcgtgaaagtggaaggaagctgggatagggtagcgtggagtaatgagacagaatagggtgggtctggagggcagggactgaacgcagcgcgcctggagagctggctagaacgtcgctggtcgatagaggggcggggattgaacgcggcggggaggtaagggtgcggggatagaactcggggatcggggagaggaaggggtgtgaataacaaaacgggattgaaaaccaggagaggggtggggcgcagtggtttacgcctgtaatcccagcactttgggaagccgaggcggttggaccgcttgagctcgggaattcaagaccagcccgggcaacacagcaagacccagtctctacaaaaacaaacaaacaacaacaacaacaacaaaaaagtagtcgcggaggcatgcgcctgtagtcacagctacctgggaggctgaggtgggaggatcgcttgagcccaggaggtggaggttgcaatgagccgagattgggccactgcactccagtctgggcgacagagtgagaccctgtctcaaaaaaaaaaaaaaaaaaaaaaaaagccggatgtggtggtgcatgcctgtggtaccagctactctggaggctgagtatcgcttgagcccaggaggtcgaggctgcagtgagctctgattgggccactgtactccagccacggagacagagcactgccctgtctcaaaaaaaaaaaaaaaaaaaaaagaaggaaagaaaaagagagagaaagaaaaaaacaagaaagaaagaagaaaaaataagagagaaagtaaaacaagaaagaagaaacaaacgaaaggaaggaaggaaaggaaggaaggaaaagaagaacgaaagaaagaaaagaaagaaagaaaaagaaaaaagagagagaaagggaaagaggaagaaaaaaagtgaggggagagggcaaaaagcggtaaggcaagactcaggataaaacacggtggtgtggccgggagcggtggctcacgcttgtaatcccagcactttgggaggccgaggcaggcggatcacgaggccaggagatcgagaccacggtgaaatcccatctctactaaaaatacaaaaaactagccgggcttggtggcgggcgcctgtagtcccagctactcgggaggctgaggcaggagaatggtgtgaacccgggaggcggagcttgcagtgagccgagatcgcgtcactgcactccagcctgggcgacagagcgagactccgtctcaaacaaacaaacaaacaaaacaaaacacggtagtgtaaaatggagcggggccgggatggggcggcgtaagaggaggagaaagaacgcggcgaagagtccacggaagagcgaggatccgggtggcagaaatcggacagggcctgagtggggcgggtcacccaggggccgagccagaagaagggcccagctgacttgggggcgggccgtgctccggagcgctgggtgggtgctggggtctcgggggaggagaggtgcgcggggcttggtgacgggaacacattctcctcccgcccgtgcctcccaccggcgcctctccccgccccctgcccccgaccttaccccagagttgcgccatcagcagcggcagcagcttcgccagagcccgggcgccagaggcggcggagaggtggaggtgcggagctctcatggccaggatctgctggggtgtgtgcaggggcgggttaaaacagatgctccgttagagacccccacctcgccgcgctcatccgcccagcctgggccaccccagcccgcaagcacccttttgacctgcagccgataaccccaggggctggcagacgggagattcgggctggaacagcggtaatgggcacaattaccctaatgacgcccctcgcggcatcttcccgtcctccctgtgcccgagtggagcgctctccgcgccccagctaccctggctgcagccacgccgcgcccgaggtttccccctccttcacgcgcggggtggggatccgaggctcggagccagtgggagcctctttctcaacctcacagcggggggacttccgcgtcccgcaggtggagaaaccgaggctctaagccggctcctgcctgtggcccgggggtccccacccatcctctcgcaatccaccccaacccgggtggggtgcaggtagcttcacctgggagtcgccgataggaaggagggaggggacccagacgtgcctctgccctgcctgtggtctgccgctggtatcctctgcccagggacccctggcgggaccttcccttttaaccccaaggagtccggaagcttctccaccctcccctacccccacccccgggctccctccctttccctctgtctaattgtaccgtgggtgaggctggcactcctgggtcccagattcctgctctgggaggggccctggaatacaggcttctcccagtgcccgaaacgcccccttttcatcccttttggaactggcttccgtggggattctccgggtcccggtgccaagaaggcttcccaggcgcggggagagggttcacgtccccagcaaggctaggggtggcaggatgagaggccactgagcaagaggaaatcaatgggaagtgcatacctagagtgacaatgtgagaagccagactgtggaagaggaaggaggaaggcctagagataaagcaggttgagtaggagggacagaggctggcttgaaaagggagattgtaacaaaccaaggctaaaagagccagagagagagagagagagagagagagagagagagagagggagggagggaggcgccgaggctaagagaaacagaaacaaggaaaaagggaaacccacgcccactctgtggccgtgagtgagctctgtgtgtgtcccagtgactagcccatgtgcgtgttggggggggctgtggctctgcctcatacccatgtgtggccatctcacaccctccctgccatctgtgtgccaccaggtgacacacaggcccctgaatcataggaggtcaaagctgtgaggggcatcggcatcacctcagccaactccctcatctcaggtgaggagtgagaggctcagagagggcagagactcacaggaggtcacacagcaagtccacttgacaaccagaaggccctggttccactctgggctcctattgctcatgccagccacttctgcgaggtgaacagaccatcccaaaagatcctgagctggccgggcgcggtggctcacgcctgtaatcccagcactttgggaggccaagggggggcggatcacgaggtcaggagttcgagaccagcctggccaacatagtgaaaccccatctctactaaaaagacacaaaaattagctggggatgttggcacaggcctgtagtcccagctactagggaggctgaggcaggagaattgcttgaacctgggaggcagaagttgcagtgagccgagatcacgccactgcactccagcctgggtgacagagcaagactctgtcgcaaagaaaaaaaaaaaaaaagatcctgagttctggattctctccgtgggacatcctcttcagaggccatctaactcagtgctgctcagctgaactttctgcagtgatgttttatatgcactagctaatccagccaccaccagtcacatgtggctatccagccttggagatataacaagtgagacagaggagttacatttctggctttatgtaattttaattggaagagccagctgcggttagtggctaccatattggccagcagaggtctccactatctaattacctatcatggaagttggagaaaaacaataagctcctttggttaggtcttagtatgtgcaggctaactgacttctttacttactgtgttatacttttgcatgcagcattttacaggaaaggaaacaaacagagccttactccaggaacatcacttggtaattaagagatcgccttgcttcagatccttgctctcctagccacgtgactgtgagcaagtgactttgcttctctgtgtctgtttcttcaactataaaataggtatgaaaacagtaccgacctcacagggttttgtgaggattaagttgatacatttgaaagtgcttggaggccaggcacagcgactcatgcctgtaatctcaccacttttggaggctgaggaggacagactgcttgagcccaggagtttgagactagccggggcaacatactgagacctctgtctctacgaaaaatacaaaaattagctgggcttcgtggcatgtgcctgtagtcccagctactctggaggctgagggaggacaatcacttgaccccaggaaattgagattgccgtgagctgtgattgttactgcactccagcctgggcaacagagcaagactgtctcctaaatagattaattaatttaatttcttttaattaataaatgaaagccgggcgggcgcggtggctcacgtctgtaatcccaggagtttgggaggccaaggagggcagatcatctgaggtcaggagttcgagaccagcctggccaacatggtgaagccccatctctactaaaaaatacaaaaattagccggatgtggtggtaggcacctgtaatcccagctattcaggaggctgaggcaggagaattgcttgaacccaggaggtggaggttgcagtgagcagagatagcaccactgtactccagcctgggtgacagagcgagactctgtcaaaaaataaaataaaataaaagccattggatcagggtctagcacatagtaagcactcagtagattcactcatttagcaaatatttattgaaaccttgatatatggccaggagctgtctttggggctggggatacaacagagaacaaaccaggtgttgtcattcccagagtcacaatatttcaaggcagaatttgaatccaggtctcactgatttcgaaccccaggttgattattaagtgacagcatctcctgtagtccaggaggcccaaagaatgttcgtagagggtcttggcttagggtttcttattaacagagtgaacaggaaccaaacaccaagtggaaatggagggtgatgggctgtggtgggtgggtccagtctaattgttcttcatcgtctcctggatccagtccacatatttgcagactttcgtgtagacaccaggctttcgggtgatcgcacacggatcctggccccaggagataatgccttgaagagactggttacagaccagagggcccccggagtcaccctgggcacggggagagagaatgtcggtcagagaaagcgttgagcatggtgttagccagggaggaggtggggacggtgcttaggagtggggccgagacaggatgggtaggcactgggaaaggtgataggtttagcgataaagctgggattatgggtgggataaaggatggggttaggctcaaaaacgagtttggggatggttggagctggaaatggtgtggaaacggggatggagctgaagtttgtgctgaggtcagaaacgggaacaggggaagagatggattgggagttgcaggggtcggcgggttgaggttggggatgaaattgtggatgtcggtaaagatgtcattgaagctggggatggggatggggctgtggttggagaccacactgacctggcaggagtccttgcccccttcctgcacgctggcacacaccatggtgtctgtgatgttgccggggtaggcgttctcacacttctggtgctcaatgatggtgatgttggcgcatcgcaaggtgtgaggcaggcgtactgtggaaacagcgtgaggggctgtgggaatgagccccctgccacctcccctaatgcagtgcttgctgtgatcccgcccctgggggaatccctgtccttagacgcagccaactcacctctcttcttgtaacaatagcaacagcaatgctatccagctttttttttttttttttcgagacagagtcttgctctgttgcccaggctggagtgcagtggcgtgatcttggctcactgcaacctccgtctcccaagtttaagcgattctcctgcctcaacctcccgagtagctgggattacaggcgcacacaaccacgcccaactaattttcacatttttagtagagatgggatttcaccacgttggccaggctggtatcaaagtcctgacctcaggtgatcttcccacctcggcctcccaaagtgctgggattacaggcgtgagccacggtgcccagcctgctatccaataaatgatttatgtcagttgcttgatatacattatctctaatccaatcctgacaggtgggtataatcattctcattttatagagaagaaaatcaagattcagagaggtgaagctgcttgcctaaggtcttacaaccaggaggttatggatgtatgattgcatatcccgtccgtctgactccaaggccccaacttttgtccccacccccctatcctgacgttttccacacatcctctcaacttatcccacatcgtcactgtgaaccgcatctctgatgccctgaacccttccacaatcctgaccactccctcctcaccaccccctgccaggttcccctctggtgctcctacactgggggctggacgtgctgccccagccggaaatgaggcagctggtgccagcagtgacacagcgtgaggagagggtgaggggtcgcacagcccaggtgatggagactggcgatgccatcttcaccagcatgatgtcattgcggtggtctttgttggggaggctgttgttgaagccggggtgggggaaggactcagtggctgtccgggtctgctcacagccctcctccttctggaggttgtgctgccccaggtgaactatgtagcggctgaggtgggagagacagtagttggaggaggaaaggtcgggggagacatgggtgggagaggtgagtgacacctttgaggatgaagaaacatcgctctgcttccaacctcttccacgtctcccaccgaagcccccttcccagccatagccccatcccaaccccattcatccccccaccttcaataccaactcgagcccatcaaccttgctgacactacccatccccatctctaatccccttaccagcacccctatccctgagcttctctccatccatctccccattcccagccccccaccccggcaccgccccagcccccgcacccacggcttgaggcagtgggctgctgtcaggagccatctgggggcgatgagcgtcgccccacagagtagccgcgtcttctcgaacagggctgcctgccagggctgggagtgaggcttgcactcgaaccccttgatgatcctggtctctccccctacaagccctggagggggtgagagcaaaagaaggggctcaggaaggagaggtggtagaccaggaggactcccagaaatgggggtggggaggagagaaagagagtgggtggtctgggccctggtctggtgtccctctgggttgccctggatgctggggtcgggtattaaaggatgaaaatacttccataaggtcaaatgcagtggctcatgcctgtaatcccagcactttgagaggctaaggtgggaggattacttgagcccaggagttctagatcagcctaggcaaacatagtgagacctcctcccccatctctacaaacaattaaacaattagcctggcttggtggcaggtgcctgtggtcccagctaccggggaagctgagatggcttaaggatcacttaagcccgggaagtcaagactgcagtgagccgtgttggcaccacggcactccagcctggacaatagagcaagactttgtctctgggaaaaaaaaaaaaggaaatacttccatactggttggtcagtagcccctgtcctgggcgctttgagtgactgctcccccaactccagcttcctcagcccctccacgggaccctttacgacccccttgacctctcctcctttggcatttaaagggattatctagaagggcatccaggccctcatgaccactgctccagttcaggtgccttatgggttgttctgtaatttggaatcagccctgtcactgtccagacacagagggttaggggatcccagagattcaagagggaggatcctgccctgcccccatcccctgcgtacctgttgccagagcaagcaggattaactgcagaatcctcatggcctggaggggggaggagcgggccccaggttcctctgggaacaaggagggacatggggccgcatcactttacggggaaatcgggaggggggggctggctcatgccctctcctctctccctcacctgctcccgctccccacttgggagaaacaaggttggggaaatcccctgtttctcacagcactcagatctccaaacacttaaaatatatcttaggtgtctagggtggccttggagagggcctggtcacagctagaagcttccgagataccaagaaccatgtggaagtcgttgggaggggctttgagctgtcaagccatggttcggccctgttcaagtcagccatgggacctccccggcacatgtcagaggatgttttccttcttgccttgagagctggccaggccccagcagcttggggtggaaggacaaggggaaccagacaccgttccgtagccacccctttttcattgtcttcgcagcagagcgatatggagcctttgaggtctgctggaggggagtagggggctcagccccagacaatgtctgggacccccatcacccggcttgctgaagccctgtccgccaaacccctgcccttttgaaggacagccaagcaaagctgggcggggctggtcgaggggagggccagtgccctccgctgccctggccagcgggggtgggagcagagggccagctcagcagctgaagccatggagattagaggtaactgaggctgcggacagccatcggaggtgagaggtgtagagagaggccaggaacccccacccaagcagagaaggacagagcagagggagaaatgggtgcccgagtgggacaggtgtccttggggagggctgacacctggacggggaggggcagcttccctttcctcctggactcacaggctctggggctggggctctgggggcccagtggcggcggagacggcagtggcggcagctacagcaggtaggctgggttggagcgccaggtgccaggcaccaggcaggcgggctggcaggggggcggccctgggcgggcccaggatgactggcctccaagccctgccttaatgccccggggcggggtgtgtgtgagggccctccccggaggcctctgaggcactggctgcctgcctgtgccacctctccaagcccctcttctccctgtgtctcagcctccctctgtctgtctgtctgtctgcagccttcctttccctgccctgagtctctgaatctgtgtctcgttctatgtgtcattccctgtcattcagtaattctgactttgtgtgatttttctctttctgtccctatgtgtctgtctgcctttctctgtcctcgtccctgtctccatctccactcttctctctctgtctggctctgtgtggccctttctctaattccttctatctttgtgtctctcagtcagtctctctgactgcatctctggcaatttgtcttgaaatccctcttcttccatctaatctccgtctctctttttcctcccgtcccagccactccctctccacagccccagcccaggtgggcccctggcctcccctaggccgctcccttctcctttgcaaggagagggggggtgtgctgggatgtcacacaggtggggctgctgccaggcacaggggcaggaccggagggtgggggaggcaggtcagggcctgtggaagccgagtccaggaaagggaacagagcccttggctgtgctccaccccagggctcctctggggcctcgctcctctgctgacccttcccctgcccgcttctccctgccgcccaggcagcccgagtccagctgttcacttactggctgctgtgagacctctgcccgatgacttccagtcccgcagccacctcaacctctgcatctgcggaacccgagcgcagattcctgcttctcccagcttgtttgttttcagttaggtcccttcccttggctttcctcccctctctcccctgaccaggtgtggagcaaggcaggggagggcctaggttctgacagcagccagccctggcctcaaacctaggtgcttcctcttcctactactatgactacccttatgacgtggggacaagggactccacccctgcaaggctcagtttcttcatctgagagatgggggtgacagacctgcttgcaggggaggttgggatcaggcttccaggagggtccacttggaaagagcagactgcgggggggctcagcaaatgtgcctccgctggtatgatcacccctcactccctccctcctccagtttcccttcagtgcatttggggagatggtctctcctcacctcttgagtcccagtggagacagaatccaaggggtgggcaggaggattaaagacgtaggctgagctctcctgctttccaagcctgcactccacccttcgtcttattagaacaaagccacgtcccacattaaagatacaatgtatgcttcattacaagaaagtaaactgcagttggctagtggaaagaatgctacgttttatggacattggattaaatggtcataaatgttgactttgcagctttcatctggtattttggagctaacaattttctttttctttttcgggtcttttgtggactcttgaaaagcttataagctctgggcactatttctattatgccagatgaagaaacatgtgtcttatttatattgctgggtttttgtttttgagacaaggtctcactttattgcccaggctggagtgcagtggcatgatctcggctctttgcagcctccacctccccggctcgggtgatcctcccacctcagcttcccaagtagctgggactacaggcacgcaccaccacacccagctaattttttgtgtttttgtagtgacaagatttcactgtgttgccaggctgatctcgaaatctgagctcaagccatcctcccacctcggcctcccaaagtgctgggattacaggcgtgggccactgcacccggcctatattattaaaagtaactttttctactccatttctgagtaactactcagggaagaccctcatcctatttgagcactgggttttttgtttgtttgtttttgagatggagtctcgctctgtcgcccaggctggagtgtaatggttcaatctcggctcgctgcagcctctgcctcacgggttcatgctattctcctgtctcagcctcctgagtagctgggattacaggcatgcgccaccatgcctggctaatttttgcatttttagtagagttggggtttcactatgttgaccaggctggtcccgagttcctgacctcaggtgatccacctgcctcagcttcccaaagtgatgggattacaggtgtgagccactgtgcctggccttatttgagctctgtttctactcctatgagatagggaaactgctgagtccttcttccagtctcaaccagcatgaggacttcaaatggacagacatggcccctccttcatttatatttattccagactattgcacacttctctcaccccgctcgtgggtcttagaagggctggcaggagttaaagttccaagaagttcccaggccaacaagagtggagctaggggaagtgatggaggagatattggtgctctgagggccagaggggtacccaagttaaggggtgggggtggaggtggaggaaacaggtcagttgttcctcatgatcatccggatccagtccacatacttgcaaatataggtgtagactccagggatgccatcttgtccacagggccccacagacccccaggacaccagaccttgaaggactcccccacacaccagggggcccccagaatcaccctggaagggaagagaagtactgtctgaacaagggagacatcttatttctgttttcctccccaacccttcaacccagtcctgggccttggggagggctccaagtctggtcattagacaaaagagtataatcactttcccggaggacaatggcaatggctaaccaaaagagaagaaccactgtctctaggggccaatcccagggaagaagggtggaactccataaaggacagaggttctctcaaggacaatggctggggccctgaccaatgaggagagagagcacagtcattaatgaccaatctcaggggaggctgtcaagacaacataaagagtcgagcattctctcaaggacaatggctggggccctgaccaatgaggagagagaacactattatcaatgaccaatcccaggggaggagggtgggactccataaaggatagaggttctctcaaggacaatgcctggggttctgaccaatgaggggagagagtgccatcaaaaatgaccaatcccagggaaggtgggcaggactccatcaaaagcacagagttctctcaaggacaatggc

SEQ ID NO: 1124 - DNA, 26349 bp, Homo sapiens
attgatgttaggggttatgattggccgaacgcgggttgggtagctctggttgaagtgaggtcatggacccactgagggctgggcaccttccaccccctcacttgatgaacaagcccacggctgaaagtcacacacaaactggaccaaatccaagtgcgcttctgtcacaggtgcaggtctttcctccaccacagagaaccgggctggagaaagaagaagaaaggacccgaaaaagagatggtgttcctagtggttctgacctcagactctggagctagactgcctgagttcagatgatgtgactgctctgtgcctcagcatccccatttgtaaaatggcacaatcaatagcacttgccttatggagaagggttaactggattaatacccaaaaatgcttcgaagagagtgtggcatggaccaagggccacaatgctcctgttaaataagtaaagcttaagatggaggcatctgacggttccaggaggcccctccctatcttggcttcaaaatgggattctttgtcaagcaggaactggaacttctggttggaagtgctagctgggatgagaaagtaggccccacacccaggcccagaggaggggccccaacgcaaacatgaagggaggggaagactgagagatacaaagggctaaatacacagagacagaaagatggggcaggtgggagaggacagaaagaaaattcagaggacagaggcacagagatagaaagagagagatgcccagtgagaagcagactcttggtgagaaagaggcacagagagttgagaaacatggattcttctttagagctggatccgtgttattcaggatgtggctccagtcatcatgcatcccaggcagcaataacacatcgctttcatccatcagaatagcaaaaattagaaaggtcggtcttgccacctacctgcgtgcccacatcctctgtctcctctcccatttctctagatgaacagtctgcacctgcagctaagatagatgcctccactggtgctggtatcctgtcctctcttgccttctggagggcattgctccagccagcagttctctgttctctttcctgcaacatgttttccttcttctccaaggagcagccccattagcatgcaaatatactacagtttctcccatctctcgttaaaatttgaaaaccaaccaacaaaaatttctccccactctcatgttctccttcagctcctggcccattttctgctctgtacaactgcaatccttccctaaaaagttggctaagctcactgcctgcaattcctgtcctcccgtcctccctggagcccacactatgaaggctttctctcccattgctgtaccaaccatgcccctgtttagggcaacagtgacctccacggtactgaatccaagggccgtctcttcaggttcatcttactggagttatcagcagcatttaacaagtggactactccctgtttctttccttggcttctgggacactatgctctcctggttttcctcatcactcactggttgattctcatccgtgtctggaggtggtttcttcctgtctccccagtctctacatggtggagcacctcaggcttcggtccttggccttcttctctcctctgtctatattcactccctcggtgatctcatctggtctcgtggctttaaataccatctacatgttgacgactcccaaatttatgtctccagccaggtctgactctcaaactctccacttaacatccagctgcctactcaacatctccatgttcaaaaccaacttctgttctctgcccttcccatgttccaaacatacttctcttgtgggtcttgggcttctcagcggatgttcacaccatccttttcattacctggtcaatacttcagtctcaccgtcgaatcccttttctcacaccatacatacattttgttaccaaattccatcggttctatcttcagggtggatccagaatctgactgtttcttaccacattccatctttgctaccctggtcccactcagcctgcatcatctctcacctggattactgcaagtttcctatctggtctctttgcttctgtccttgtcctcctacactctaattttaatgcagctaccagagtgaccttttagaatgtaagtcagagcaggtcacttttctcaaaaccctgcagtagcatccactgcactccaagtgaaagtggcatttccttctggttggcatataaggcccaagatcttctcttctcttgtccctctaatgctgggcatgcttccatctcagggcttttgtgcctgaaaccctcttcccccagatgtctgcatggtcccctgtattcttgccatcttcttcatgaaggccctcttgaccactgttcttgggagtctccaggacagtttcagtgattcactagaaggactcataaaactcagaaaagttgttatagttttggtttcttacagtgaaaggacacagattaaaatgagcaaagaaaaaaggtgcatcgggcagagtctgggagagaccaggcatgagcctccacctgtcttctcccagtggagtttgtggacagtgcataattcccccagcaataatgtatgacaacacgctggagcatcgccagccagggaagctcacccaagccttgatgtccagggtttatattgggggttagtcatatcgacatgactgcctgtttgtgtggctgaccttagctccagatcctctagaggtcaaattgatacaacatgtccctaggtccccaccataagtcacattgttatagattatctggcatggctcaagccccagagagacaaagacactgttacttagcaagatattccaagagcatagaggttatctcccagaagccaggcaagggccaaaagtttcactgtagtgtgcagggtttggacagtccaagcctgctgggttgtacaaccacccaacataaaattgcaactctcctctgacattctctatcctgttactctgctttattttcttctatggcatttattcccatctgtcaggcgtaatgttttacttattcatttgtttctgtctgcctcccctctagaatgtgaactccctgaggaaagaattgttcaaatattttgctcctagaacaatacctggtacacaatcagatttaatgaatatttgctgaataaataaatgaactatgggcattaaatatttactgaatgaataaatatgtgttacaggctgagaaaatgggggttgtgaccaactcagtttaccactcgaggctatatgagcaaacagaaaactgttctcatgaaagcaggatgttggaaaactgacaactgcatctgccaccagaaaaggtgctgagggcagtcacgcctcaagcacagtgttccttgtgattatccgaaagaacatctgaagcctgttgtacaaagaaaacaattatatgtacctgtgattaatcaagcagctgatcaaccgttacctctccctccctgctctttctacctaatataaatgaagggctgtagaagctcaaggctgcctttgctcaccagaagcaaggagctccctgacacattctttcaaaacagatctcttgtctttatttctgcattcgtcccccttcattcacttccgtaggaaccgtcagtgacaaatatggatattgttgaaggtgtggagagggaagaaacctaattttttttttttttgagatggagtctctctctgtcacccaggctggagtgcagtggcacgatctcggctcactgcaacctcagcctcccgggttcaagcaattctcctgcctcagcctcctgagtagctgggactacaggcacccaccaccacacccggctaatttttttgtatttttagtagagacggggtttcaccgtgttagccaggatggtctcggtctcctgacctcatgatctgcccgccttggcctcccaaagtgctgggattacaggcgtgagccaccgcacctggtcgaacccttctttgttagacaaaaacttgccagtattcggtgaaattgattaagaataggcctttaggccccttggtcccactcctgtgtgaatggtcaagaggagtcttgtatagatacataagtggcacgctcaaagtgaagggaacctaggtgtccatcactgaaggactgggttactaaacatggtggatgtgtactatgcagcggcgcttctcaaatcctaacatgcactgagtgccctggcaatcttgttatatataacgcagattccgattcagttggtctgggtgagatctaagactccagttctaataagtgattcagaattgctattttctgcaccacgctatgtgaagcaagggcaaaaaccagagtagtgctgttcaatgggacttccagtgatgagatgcaaataattctatctataatatatccgtgctgtcaatatggcagccgctagccacgtacggttattgaaatgttgtgagtatgactaaggaatggaattttaaggtgcatctaattttaattaattttaatcaaaaattaaatggccacaccagttgtggctaacggctaccatattggacaacatatgtctagaagactctggggcagttagaagcagtgaactagatgagcaaatagtgatgcagatagattgttacaagatgatttgacgaaatcagatgacgtatttaataatacaacctgacccctcacctacacctaccttccttcacacactatttaattgaatgtaaaatactgttgattatattgcactttattttgtagaccactcagaaagaaaaagaagttgccaattaaattatgaggtgtaagacatcatgctgaattaagatgtaagatgcttcctaatttcagagatgtgaaaaatatgaaaagaatgtgtctttaaatcaataaaatataatgttcaaccaccatagctggaactttgagttgcaaataaaattaaagtagtctttaaactatttttatttagctttatagaaggatgcaggttgagaattatagcatgagttatatcatgtcactgggtgcccaaatctacccaagtacacaacttcttttctctcctttttcctatagggcttgtatggctgctaagtattaaatccacagtgtgtgtttatcaccttgacacagaaggtgcaacctccacaaactgagacaaggacactataagaaaagaaaattataggccagtatctctgatgcatatagatgcaaaaatcctcaacaaaacactagcaaactaaattcagtagcatattaaaaacatcatacaccatgatcaagtgggatttatccctgggatataaggacggttcaacatgcacaaatcactaagcatgatatacctcaacagaatgaaggataaaaattatatgatcatcttaataggtacagaaaaatcattttgcaaaatacaatatcgtttcacgataaagacagtcaacaaattaggtatagagagaatgtacctcacacaatagaggccatatatgacaagtccacagctaacatcatacccaatggtgaaaacttgaaagcttttcctctaagatcaggaaaaagacaaggatgcccactctagccatttctattcaacattagcactagaagtcctagccatagtaattaggcatgaaaaagaataaaagacattcagatcagaaagaaagaagtaaaattgtctctgtttgcagatgacataatcttatatgtagaaaaccctgaagagtccaccgaaaaactgttagaactaataaatgattcagtaaagttgtaagatacaaaatttggttgtgtttctacaccctaacaatgaattatcagaaaaaaattgagaaagcaactcaatttacaatggcatcagaaacaataaaatgcttaaaaataaacttaagcaaggaagtaaataatctgtacactgaaaactataaaatgctgataaaaaaaattgaagacaacataaagaaattgaaagatatcccatatttgtgaattggaagaattaatatttctaaaatgtcaatgctaaccaaagctatctacattttcattttaatccctatcaaaattccaatggctttttctcacagaagtagaaaaaaaatcataaatatggaaccatgaaagaccctgcaatcttgggcaagaagaacaaagctagagacatcttattgtctgatttcaaaacataatacaaagttatagtaaccaaaacagcatggtactggcacaaaaacaggcatataaccaatgggacagaatagagagctcagaaataaatccatgcatttactgccaactgatctttaacccaaaggaaaaggatattctctttaacaaaagctgttggaaaaactggatacctgcaaggagaagaatgaaattggactcctatctcatgccatgtacaaaaatcaactcaaaatgggttaaggatttaaacataagacctgaaactgtaaaatgacaagaagaagacatggggaaaaaacttcttgacatttgtctgggcaatgatattttagatataacccccaaagcacagacaacaaaagtaaaaataaacaaatgcgattgcatcaaatggaaaagcttctgtgcaccaaaggaaacaaccaacagataatgatcaacagagtgaaaagacagcctaccaaatgggagaaaatatttgcaaatgatgtatctgatagagggtcaatatccaagatatataagcaatgcaaaaatcaacagcaagaaaacaaataacccaattaaaaaatggacaaagggccgggcgcagcggctcatgcctgaaatcccagcaatttgggaggctgaggtgggtggatcacctgaggtcaggagttcgagacctgcctggccaacatgatgataccctgtctctactaaaaatacaaaaattagctgggcatggtggcagatgcctgtaatcccagctgcttgggaggctgaggcaggagaatcacttgaacccaggaggtggaggttgcagtgagctgagatcgcaccactgcactccagcctgggcaacagggagagactctgtctctgaaaaataaaaaagggcaaaggccctgaatagacatttctccaaagaagacatacaaaggaccaacaagtatgtgaaaaggtgctcactatcactaatcatcagggagacacaaattaaaatcacagtaagacatcacctcacacattttggaatgactagtatagaaaaggcaaacaataacaaatgctggcaaggatgtggggaaaaaaagtgaatccttgtaccctgttggttggagtgtaagttggtgcaaggaaatgaaattggcatctcaaagtgatatctgcacacccatgttcatggcggcatcattcatgatgaccaggatatgaaaacaacctatgtgtctgttgatggatgaatggataaaggaaatgtaatatattagtatcagtataatttaatattattctgccttataaaagaaagaaatcctgtcatttgtgacaacatggatggaccgggaggacactgtgttaagtgaaataggtcagacacagaatgacaattactgcatgatctcacttacatgtgaaatctaaaaaactcagactcttagaagcagagagtagaatggtggttaccagacactggaggatggggtgggaggatgaggaaaaggagggagcctctacttcccagcaatctttcgtgcatgtcccagacctgccaccttagggttccccaatactgtgctgtccccatagaacataaggtgagtacaacattctattttagctatactctgcagtatccaagcacagaactttgagaagacagacactaagatcatgaggtcattcccaggcagacccatccaagggtgcctggtaaaggtttagcaatgactgtccggcaaagccctatctatagtgtttttcaatttcagtgcagtaaatacttcttctttggctattgtcaagctactggtgcagacagagttggggagttggaaagaggtgtgcagaaactcatcattacagacgtagtacaagagacatatctcactcccaagcataggtattagttgaaataattagcaacagttgagttttgagtatttactgacaatttttttaatcaattatgtaattatacgcttatgtaatttaatttttaatgatggctgcatttagcaactggttctcgaaattcctgaaaatttgctggtagactcttgcgagcatgtatgagctggccctggcacacattgggcctgccgcccagcccaagtttattgacctcgttactcatagggactctgctttattttaaaattatgtttatggcttcttgtctgtcatctcctgctagaatataagttctgtgagggcagggattctgactggcttgctcacagttcttcctccagcacccagaacaatgcctggtgtatagcaggtgcctaataaatagaccaatgcctggcccgtagtaggtgctcaatagctgttgatgagtgaaagtaagaaagagaatgagattcctaacacaatggtttcatgtaaattagaaacagtacactgtgacactgccttgttttccaaggatgcagggcactcaaagccatttatgtcggtgcctgtggggagggaggggagcagagccagagatgaagagtggaaataaattaataaaatgagagaagggctttgcctgggcaggaactgaagcctgtgattaactcaactctcctcacctgagatctgattaggaaaatgaggacatcttcatttgcatagaattttccaggaaacaaggcacttagttccctaccctggaccacaggggctccagggaggaggctggtagaaggcagtcatgctcaaggtcactctgcagggctgaggtgtttccgtctagaaacctgatacagtggggtggacgggggactcccaaggaaaaacacgcaaagagggaggcagccacttgtcagtacacagctcctggcttggcatggtggggccactgtgtacatgtttcttgaagtcattaattggatggataaggctgggcgcggcagctcacgcctgcaatcccggcactttgggaaaccgacgtaggcggattgcttggggtcaggtgttcgagaccagcctgagcaacacagggaaacctcatctctacacaaaatttaaaaagtagcggggcatggtgacgggcacctgtggtcccagctactcgggaggctgaggtaagaggatcactggagcccaggaggtcacggttgcagtgagctatgattgcgttacagcatttcaccaggagactgagcaagaccttgtctcaaaaaataaaaagtaaacacatggatgaatgaatacaatttaggatgattccatttttattgtcattatttattcggtttttagagacactaagcgtgttaaaaattgtcgtctttggaatacaatgccggtttaaggggtctgtgctcctgccctctgtgcctccggtcttgagtagtgatggtgacacagcaagggtgggggcttggtggggagaaaacgcctgaagcaactgctctgggaaaggagagatcagagccggagtaaagatcaggatgctggggactggggctcctgggtctgagggaggaggggctgggcctggactcctgggtctcaaggaggaggggctgggggactggggctcctgggtctgagggaggaggggctgggcctggattcctgggtctgagggaggaggggctgggggcctggactcctgggtctgagggaggagggactggggcctggactcctgggtctgagggaggaggggctgggggcctggactcccgggtctgagggaggaggggctggggcctggactcctgggtctgagggaggaggggctgggggcctggactcccgggtctgagggaggaggggctgggggcctggactcctgggtctgagggaggaggggctggggcctggactcctgggtcctgagtagagagaggagggcctgggcagctgacgaggtccatcccaccgtgaagaccatcatttgtcccgcatcgtttcctcaatccagcttctgtacttgcacaggttggtgtagacaccggggtagccaggcagggcgcagcgctccattccccaagacacgaggccctggagctgtcctctgcacaccaggggtcccccagagtcaccctgagggggaggaacagaaatggagacactgatggacaggtagccagagccaccatggcacagagaacccgagaagcagacacagggagacaggcagagacactggtggacagttagggacacagtcctgccccagctctgaggtctcagccccggaggtcggggcacttccttccctctccgctgggtctggctctgtctctgtgtgcacctgcctgtcccttgaatctcaccaggcccctctctgttcgctccaactgtagaacatttgtgtgtctctctttttctatttccccatctctgcctccctcaaggatgcattaagatttctagaagcctcagcacagcctttcccagacccatatgagcagaggccactctgcgatctttccccaacctgcctcatcccattccaccaactaccctaagagggttactcccacctgacagatgaggaaactgaggcatgaatgctctgagtccattacccagggggcacagggctaggaagcagggtggcctggctatcggaatctctctgtgcctgcggttcactctcttctgaagacctctgcagacttccatgctcctgacatcatttgcttaaatcccagtcccaaataatccctaccacagctcccatcctgggccttacctgacaagagtccttcccgccctggggaactcctgcacagaccatgccaggcgtgatggttctaggataggccttctggcacacctcatccggggagatgttgatgttcacgcattgcagagaggcggggtacctggctgggggacactgcagggttataactgggtctaccctcccataagacccaagggtccaggcccccagcccctcctccttccgacccaggagtccagccccagcacctcctccctcagacccaggagtccaggcccccagcccctcctccctcagacccaggagtccagacccccagtccctcctccctcagacccgggagtccaggtccccagcccctcctccctcagacccagaagtccaggcccagcccctcctccttgagacccaggagtccaggctccagcccctcctccctcagacgtatgagtccaggcccagctcctcctccttgagacccaggagtccaggcctcagccccctcctccctcagacccaggagtccaggcccagcccctcctccctcagacccaggagccccagtccccccagctccacctcctggagacccaggagcccaggcccagtcccctgctttccaagacgcaggagtcctcaccgatggggctggatatagttccccagcctgacactcggcaggaggtcccggggctggcacaggcctgggtgacctcaatgggcctgactgccctcccgatccgtgcgggctgctgtagctgcagcagcatgaggtcgttgtcgtgggtccgggagttgtagttggggtgcgtcacctgacgaaccacgcgcagcacctgctgggtggcctcccacctcctcaggttgtgcttgcccagggcaacctgaaggatcctggccacgacccccaagagaagcgctgctcagggtctgagccagagactcctccccaccctccagcccggttccctggccgggtgacgagtcttccccgaggtctagcctgcttctcactaactgcaggccgagcattcttggcctcctgtgcccttccccatggccagggcattctctcggcccagccccagctgcctctccttccgctcttgggctgggctccagctcctggcttgggaagaaggtgatgattgggagagcttggctccgtgccagggtctgtgctgggctcggtgcattgagtcctaagcgaaactgcgttatgagtctaggctctaaatcggaactgatattccggagtaggcaccattctgtttctagcctgggttctgagttctagacatcttaaacttttgactctatgctaagatcaggattctagatcgaacctggattatgacttgatttatttatttattttttttttgtgatggagtctcgctctgtcacctaggctggagtgcagtggcacgatctcagctcactctcgacctccaactcccagttcaagtgattctcccgcctcagcctcccaaagtgctgggattacaggcgtgagccaccgcacccagcctctacaggtctgtttcatattggattatagggctcttggttctggactctggccctagcccttgacctcaggttgggctctgggttctagttggagctctaggttatggcccggatccaagattctagagtctggtttgcattctggcctttatattctagactctggcctgagctttgatctctaggttctagactgacctgtttatggcatagatatggcttataggcattttgacctcttggctggggtctgggttgtaagttcagatctagaatttaggaggggtctaggttttatatggggcttctgattaggatctgcattctgggatttattgattgattgattgatatggagtttcgctcttgttgcctagcctggagtgcaatggtgcgatcttgactcactgcaacctccgcctcccaggttcaagtgattctcctgcctcagcctcccgagtggctgggattacaggcatgtgccaccatgcctggctaattttgcatttttagtagagacagggtttctctatgttgctcaggctggtctcgaactcctgacctcaggtgatctgcctgcctcagcatcccaaagtgctaggattataggcatgagccaccgcacccgccacattctgggattcaaacactgggttgaagtctgctcatagcggagctatagactagactctgaactaaaccttgggtgtgaaacagcctccaggttttgcctctattcttagagttgtatgttccagctgtgagcagcgttctagttctggatttatggctagactgcaggtcctgaactgggctctgagttctacgtagtgtcctgagtttctgaatgtagacggggtcctgaattcagccaccaatctggaatgggctaagcttggtctcgatgtaatgtgtggcctctggaagaatcactggatcagatgttcggttctcagcaggtccatgggttccaagctgcccatctgctttcagaacctatgctgagttcgagatttatggaggagcccacatcccgagctgtgtttttgttccaggctcttctctagacctcaaaccaggagccagccactacattgggttctatacagagatccaggttctcagctcagctctagggctttagactctggaattcactaggtacagggacaggggagggggtcacttacgggcggccgcagtgagcagcagtgatgacccactggcctgaaagcagggcgcctccgcagaggaagcggcgcctgggacccgccagcagggccgcctgccacggctgggagctccgggtgcacgtatggccaccaattatcttgttctcatcctcttggctctgtgtcatggctaggagtggacaggattgggtggggaaagtagatgagcaaacactctccactccacaagtttgtaggattccaaaactgacaaatccccttccttttggtctaacccctaaactgcccgcctctatctgtcccacccagggtgagacatgcccaatattgaccccgttattgccccagcacggagagctttctgactcacctcccaagtcacctccgtagcatctcttattttgtgccgtggccaccttatccagggccttgctacatctacgacccttagctctatgctcccataatttctgtgatcacttctcgaaatatgccacatttccccccaatgagtccttccccaacacattcaaggacctccctgtctcctccccaacgttcccactcagtgggaccccaaggatccgccatctcttgccccacacttgcccccatccacctcacacacccatgccacgatcccgccaccccatgccacgatcccgccatcccatcatccttctccaccttccctctgacaacaaaacatctttctgacattgtttctttcctaacacagtcaggtagagccccgtgatctttctgctatgacccactcaggacctaatagttccctaagattccttatgtattttgcaccagaccttataaacacctctctccccggccccacaattccctagcacctccacaactaggaatttaggcctccagcacgttcccccaccatgacccccaaaccactccctgctctttcttatgaggtcaccatgagcatccaggggccccaaggacccatccccatctcttctcagagtctccaggggacccccttgtgtcatacccaaccgttctcttacctatagccaggacttgaagtgctgtcagcaggaggaacattttaggggctgagggccaggtcctgtcaaatgcagagaaaaagtgagagagaaggaaccttcaacagaaccgggggctgagaggcagagacagcaaggggcacttacccagagcccaagaccctcagggacatgaagacacagcagagaggtagggaccagagacgaggggggcggggcctgcaggctctgcgggcggcaggtgggaggatgtggagcagggcacaggtccctccttgatgtcttgatgaaggaaggaggggaggtgtctctcttcctagtcacactggcaaagccttttatccctggtaaggacagctggccctgcccccacctcccgccgccctgcttctgacatttttttttttttattgcctagttcccattccaggactccctgatcccatcccctccctcccctgtctggccaaaaaagcagccacaattgttcatgagaacccgcccagggaagatgctataatctagaaggaatcctgggaggggaccccagggcagggtgggcaggggagggttcccagttgctggaggtggtggatctagtggtggagtcaggaaaccagggtggggagtgtcagaggaaagggcacgaaggggctgagagagggaggaagagatggactgagagagggagtcacgggaggagggagagagggagagagagagagagagagagagagacagagagagatggagagagagaaagacagagagacacacagacagagagagacagagacagggtgacgggggggagagagagagagagatggagagagagacagagagagagccagacagagagacacagagagagagagagaaagagagagacagagacagagtgacagagagggggagagcaagagacagagagagactgggaaaatgaatgagaagatatgacagtggagagagaggagtccaggaatacgagcacagaggcaggtgtgctcatgagagaaggaactgaggagagagctggagaaaccggtggaagttggatgtgacagggaacagaagaggcagacggtgggaaaaaaacaagacagaggaagagggagacacagagacgcagggagagaggggtgtggagaagtggagatagaaaagcaaaagacggagggaagaaggtggagatagaatggaaacagacacacagaaagagaaaacagtggagagagaggagagaggccgagacgcccccaccatgcggcactcaccacaaacacacacagaacaacagcgatgatgatgaaggcagtgcgggcatgagacgtggaagagaacgggacatggtgggagaaagaggatgggacaggcaggccgatggcagaggggagacgggaaggatgggcacctacaggggatggggacaatgacagaggagacggaggcctagatgagagatggcagcgccagggagagatggagaggaggggtgggatagaggacgggcaggaggtgggcgggagatacctggacctggagcagagctgcccaccttgctttctcactttcgactcctgagagatgggggagcagaggccccagcagggagcaggaaggttggtgccagaactggcattccccagcttgggatctgctaggtgcagagacaaagtgagagctggagatgcaaagagagagtgacagagacccagagagggggacagagacccagagggagagggagagagacccagaaagagaaggggacagagattcagagacagaaggacagtcttaacagacggggttggaaattcaaaataggagacggcagagagcaggagagacagagtgaatgagatggggaaggattctggccagcctgcaggggggttctggagttgggggggttccatcctcatttgggggagggcctaccctcctcagcccctcccctagccccttaaattccccagtgcttgtgtccgtctctgggcctgggcagccccgtacctggaccacgtggtgactcaggaggctgcttgcctcccttggctaccccaactgttccccggcctcagcctgactcagcctccctccacctcggcacccccctaggctggctctttgagctggagcttggcctgggtctgtctgtacacctggggacgcactgtctgggcacctgcatctggagccacacacccatctctccccaggtgcctttctgtgattcctgaactgtttctgtttaactatgggcctccctgctttgagctgaaggccttgggaagccttcccggcctcctctgccttggttcaggctcggcatcaacacaagaaccccctctttatttttaaatttttaaatttattttatttatttatttattttatttttttttctttttttctttttcttttttttttttttgagacagagtctcactctttagccccggctggagtgcagtggctcaatctcggctcactgcaacctctgcctcctgggttcaagcgattctcctgcctcagcctcctgagtagctggggctataggcacccaccaccatgccccgctcatttttttgtatttttagtaaagacagggtttcaccatgttggccagtctggtctcaaactcctgacctcaaatgatccaccctccttggcctcccaaagtgcaaggattacaggcatgagccaccacacccgtcaagaactccctcttttaagaaagggttctcttgggacccagggatggggtggcaggagggagctgctctgtggtgacgaatcagctttgcactggatgtggcggtgattacacgattctacacatgagataaagagacacagaagcccacgtgcacacacacacgtgcaaagaaatgcgtgtgaaaaatgaacgcgcagtgtgatctgtagtctcattaatagtttggtttctgtgttgatttcctggtttccattctgaacgacagttacacaaggtgtcgccacggggagaagtaggtgagggagattccctatgctgtgtgtgtagcctcctgtgagtctgtaattatctcaaaggaaaaagttaaaaataaaacagaatttcctagtaaacacaaggtctccctgttcctaaaaagaacaccctacttaagcagaaggccttggtcaacccccaggagcctgggagtggctccttcatgccactctatccctgagatccaagagaatcctttctttaaagggtggcaggggggcaggtgctgtggctcacgcctgtaatcccagcactttgggaggccaaggtggatcacctgaggttaggagttcaagaccagcctggaaaacatggtgaaacccaatctctactaaaaatacaaaaaaactgagctgggcatggtggtgggtgcctgtagccccagctactcaggaggctgaggcaggagaatcgcttgaacccgggaggcagaggttgcagtgagctgagattgtgccactgcactccagcctgggtgacagagcgagactctgttgcaaaataaataaataaacaaacaaataaataaagagggggttcttgtgtttatgcagagcctgagccagggcacagaatgactggaaggctccccaaggccttcagctcaaaggtagggagacagctggagatgcagctgatgaggcccagttcaccgccggtggctcccaaggacttgccgtccccagcccggacctcagcacctgccgtgccgtggccaggttgctgggccctcttcccaccacatgctaggttcccagggtatctcgctcaccactccaccacctgcttggcacggtcttgtttgctgtgccacgggcatcgataaacatctgatgaatgaatgaacacagagcctcagtcgctgctcctctgtgaactcacggtctggtgaaacaggccagcggggcaacaggaaactccatctggtgtcacgtgtgctcccctggaggaggctgaggggctggatggagcctcaggtgtgggaaagggttccaggaggaggggcagtcttagcaggttcctgcagatgaataggagtttgccagggaggatggacagtgtgtggagagggtaggagggaggtgagtggtttcgagtagggatggtggggcaggaggatggtgagagagctcagagcgtaggagagaggagtggccaagatgagcagggccctggtgctgcaggggcgagaattttactccgagggtgatgggggatggtggcatgatcctgagtaggggagagcagaatccttcgggatactcaggtctggagctcaggagagtgatggggcatcacggcacggatggtgctggataccagcggtgtggagcccacctagggagagggtatacagtgagaggaccccactgaagactcacagctcagggggtaagaaacagttatgccaggggtaggagtgattgaagagctaagagggacaccaggagggagcagtgtcaggaaagttgagagcttttttttttctttttaaacagggtgtcactctgttgcccaggctggagtgcagtggtgcaatcacagctcactgcagccttgaactcctgggctcaaccatcctcccacctcagcctcctgagtagctgggactacaggcacgtgctaccacagtcagttaatttttgtatttttttgtagagacagggtctcacgatgtagcccaggttggtctccaactccagggctgaagtgatttgcctgccttggcctccccaagtgctgggattacaggtgtgagccactgcgcccagccagagagcattttttaaacgagggagtggcaggggcggtcagatgcctctggaaggaagataggtgatgggtgattttggagagaaaggttttttgtggtgtggtaggggtggaagctgggcggagcagaggagaccataggtgcggacagctcttgggtgtgaggggaggagaagggtggttgatactgatggctgtttataagaaaggaaaacctggatggcacttggaacaaaaacaatcactcacatgtattctgtgctcagcacagccagggactgtgatgaaaccttggttgtttttttttttttttgagatgagtctcagtctgtcacccaggctggagtgcagtggcaggatctcggctcactgcaacttccgcctcccaggttaaagcaattctgttgcctcagccttttgagtagctgggactatgggtgcccaccaccatgcctggctaatttttgcatttttagcagagacggggtttcgccatgttggccaggctgctctcaaactcctgacctcaggtgatccacccgcctcggcctcccaaagtgctgggattacaggcgtgagccactgcgcccggcagatgagaccttttaaaaaatatttaaattttaagaaaattttacaattttttattgttgtaaaataaacacagcataggccaggcgcagtggctcacgcctgtaatcctagcactttgggaagccgaggcgggcagattgcctgagctcaggagtttgagaccagcctgggcaacacggtgaaaccctgtctttactaaaatacaaaagaaattagctgggcgtggtggcgcacgctgtcgtcccagctacttgggaggctgttgcaggagaatcacttgaaaccaggaggcagaggttgcagtgagccgagattatgccactgcactccagcctgggcgagagagtgagactccatctaaaaaaaaaaaaagcacaaaatcaagcattttaaacatttttaggtacaattcagtgggattcagcagattcgcattgctgtgtagccatcactactctctaactcccccagatgttttcattgtcctcaaattctgcacccactaaatgataactccctgcttctcccttccccagcccctagcaacaatcattcgactttctgtctctatgaatttgactactctaggtccaggtacctgacataataggaattggattttttttttttttttttaagagataagtcttactctatcacccaggctggagtgcagttggtgcagtcatagctcactgcagccacaacctcctgggctcaagcgatcctcccacctcagcctcctgagtagctgggactacagatgcacaccactacacccagataattaaaaaaatattttgtagagatggggtctcactgtgctgcccaggcttgtcttgaactcctgggcccaagtgattctcctcccacctcagcctctcaaagtgctgggattacaggcgtgagccactgcacctggccaaaaggaatcatatgatatttgtcctcttgtgactggcttatttcactcaacctaatgttctcaacactcatccacgttgcagcatgtgccaggatttctttccttttttaaggctgattgctattccactgtgtatatagaccacattctgtttaaccagccaagttctttatctgggttagtgtcttccctttcttttcctccctctttcccttcatctctccctcttctcccatctgccttccttttctcccccacctcttttcagcaaatatttatcaagcacctactatgtacaccctcatagttctaggggatacagcaatgaacacaatagataccccttccaaaaaaatctttgccctactgatctgtatattctggaagaaaaagaaaggaaataaatacgatatacgacattacaagttatgagggtctatgaaaaggtggcagcaagggcttccctgcagtggaaggggtctgtaggtttgggaactgcaagatggtcagtggggggccaagtgggtgaggggagaatagacagtgaggatagtgaggtcatggaaagtctggactcctcgggagaggcactaacttgtccccattttacagacagggaaactgaggctgagagaggaggtggcttgtccaaggtcccacagctggtaggtgcaggaggtatcagagactccaggactgtccgaacctccgctccacactgtaaactcttccttctgttgtctcccaaggccactaacaagttcatttgcacaccgatgtgtgtgtccaacacgatttgaacacatttcacgagaattaacttgctgacaccttcccgtagccatgggagagctcatgagtacctccggtattgttactcccctcattgtacagatggaggaagccaagatggagatgctcggccacgtgccaaggttacacaacgctgaacgggggcgccgtgatttgaacgcaggtggagagctctcaaccacctcacgaaatgttcaagaacaaaggagtggatggtgcaaccagcgatgtggtgggattagccccagacatggggaaagactcctcttacattgtttcgggaaggaagaaggaaagggcaggtcaggtgcgggtagggtgtgagcccgatggcaggaagtcgaggctggtccgtcctgtggcttgtttcttccagggagacgtcagtcggctcatctcaaggggccttggtgggtggggttgggaaggctgagggtggtggtgaaggggcccaggtgacgctgaggatcacatgttttaaggggcaccctctcagcagttggcggattttttttttcctccaacttcctggatgtagacaaagagaaggcgcctgcaggactgggtgatggtgggagggatgctgggactggggagctgagggtcgccagggcagaggggactctggggttgcccttgaactcctgggctcaagtgatcctcctcccgcctcagcctctcaaagtgctgggattacaggtgtgagccagtgcacccggccaaaaggaatcatattatatttgtcctcttgtgaccggcttatttcactcaacctaaagttctcagggggtggagacaaggggtgttggtggggaggctgcctgaggagggtcagacgtctttgaggtggaagaacaggaatggcgcagacaaccatgcacagaggcaggggaagctgtggtcagggagtgggaatgtgggattttgtggtttcagaggtggagctcttccagatagagatagaggctgggtgtgactgtgggaacgacggcgggggaggtggtctctggccacgtggaggtagtgggatgcagaagctggggtgtcctatctttggaagctggggggtcctctctcctgaagctccccactccatgtgtcagccagtacccgtctctctgtccacttatcatagcaatggggcaggtcaccaagggcttcacatacatcctctcacatttaaccctcgtgaaagccctgtggggtgagggactcttattactaccacgttatagatgaggaaaccaggccttagacaagtaacttgggcaagtggcacagccaggcctcgaacccagatcatttggctgttaaacaccatgtcaccctgtctgcaaatctgtttccatgtcagcgagggtggggagttctgtttgccttgttccccgatgggtccccagctcctagaacagcctggcatgagtgtgcacacagtgaattgtcgtgggatgagcagacagacccccgtctctgtcttcccttgggtcctgataggctcttggttggcaactttcctagtgtctaccgtgtgccatgtctcccttaattctcccaccagccccatgagacacgatgacactcattttacagatgacgaaatggagagaaatgaggtcagttgtctaacgtggcatggaagggctgggatttgaacccgagccagcctgacttgatgcctctctgcttctgatctcatgtgtgtcattgatgatccaaactctctccgggtaatctctcagacctttccgagccagcactgaaaactgctttgtgccaggcggcctctgtgtgcaaacctgggggcccctgatgctcggctgatggacagtgaacatccctgccccccatcccacctctattacctcccatttatttctttttttttttttttttcttttgagacggagtctcgctctgtcacccagcctggagtgcagtggcacgatctccactcactgcaagctccgcctcccgggttcacgccattctcctgcctcagccccccgactagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgtgcccggcccctcccatttatttctgtttaagctccacggtgtaccccaaccttccccctgtgtctcctctaagttagtatcctctccccaggtgcttgggtcaaagacgcttgggagcgtctctgattcctccctcgctctcacctcccattttggcagttcctgtcacttagctccaaagtacacagtaaagaatccacccacttgtctcctctcagtcgccctcttccaagtcacccttatctcccacctacacaggtgcaagagcatccaaactggtctcgctgcttccagcctcgacccccaacccctccctccctcgccctgctaagtccattctctactcagcagccaacgtcttcttaaaacaatatcatgttaaaacctgcttaaaacccatctgtgagtgcccactgcaattataataaaacgcaaatgcctccaaggcacttggtgtctggcttctgtccatccttccaacctcatcactgcattgtgtactgtgcctctgccccctggaacttcttccatcttctcaacattgggaggcgccttcccaacttagaggcttggcctttgctgttccctctgcctgggacatgcttcccaccactctgcctgtgatcttccttcagatttcagcttaaaggtcatctcctgaccaccttctccagagctggcattcccttccagtttccatctcagcttcttgtgggtttccttcctacaccttatctcaatctgtaattgctctatcggtttgcttccttgtttattattattgctggttttcttcctctctatggtgtttattactgtcggatgtctctcatgttttatttatttactttcttactcttacgtctactctgtctcccacgacttgaatggcaaccctgacagtgcagggattttcactgtctttatctgcctctatgccctggcacataggaggtgttcagtaaacctttgtggaaggaagaggcatctcttattagaactgaggcttcacgagggcagggaccttgtctatcttgttgctgaatccctgttgccacgtctgccacccggcacgtggcaggggctctataacaggctgaaggaggaagatcatctcagagcctgtttagaatctctgcttttctccagaatctctgcactcaatgtctccacctcctcagacctgacagcgatctccaatgacccagccccaggagagcacacaggtggaagatggggaagccggtctttctgagactgggctccaaatccctgcagtggggagaatgcttctgacctgatgggatgagacgctggcgtttcgccccactgccacctttagttgtgtttatgtagaggctgtgtttgccaaggccacaggccacagcaaaagtccctttgtccccatgaagactggggcctcctgtttagctaaaggagcgtctgtgttcacttgggcctccagcctcagcagctccctgcccctgccctccatatttaccaagccttcctcctccagcaaaagaatttcccgggtttaccatggccaccggcatatgtggcgaacatcttttttgtttgtttttgttcagtctgcctggaagaaatgtctcttggatttacactgcctttgagaacacgtagggctcttcgcccttaggaaacacaccctcagcattgaatagggttcccagctcttggtgaggacttcttaaatggccctcacatccattctcaccatcctgacaccctcgccactgccccagttttggctaccaaatccattcccagacctttgtcccagccctctccctggcctcctggctgagtcttccctactccagtccttcctggacacggccccagagggatctttctgacacccagagccggccctgtctgctctcgccctccctaagtgccccatcccggccagaagaattccagtgctttatggagggctggccaccccctccaccatcctgcacagggaggagcggcaaagcctcgcagggacttggggctcccatgcctgcaggcctctgtgcctgccattctctctgccttgcacatttgtccccatctcgccctttcctgtgctcattcttactcatctccagctcccggtttacacattacctctttcaggaagcgttccatgacgcaccgcactgagttagaagccccacctcaggcctcccctgtgtccctcctaagccccacggtggcacatatccctccggatcttgacttgccagtatccctgcccgcctccgctggcagacagggagcccattgagggcagggactggggctgactcagctgcattgccccaccgccctgcgcaggg

SEQ ID NO: 1125 - DNA, 26235 bp, Homo sapiens
ttggctgattggcttaagactggggctgagaatggggaatgggcaggaggtgaaatgcatggtggggaggtaagctgcaaatatccactcattctgaccaaatcacagagtgggctgctctctgggatgacgagagccagggacttcagtgtcagctcaatgctctttcgcttgtctgttttccttcttagttttactctccccatgaagctaggtccaaggcttaggcagcttcaggcttgtaatccttgaggagagactgcttttccttgacagcttcctaataaaaagtcttggggcagagcttgattggttgggctttggtcatgtgtccatctttgggccaattgcagggtctgcagctggggtactgtgattggctcagccagaatcacatgattacctctgtggcccagaggccagcatatgccaggagaatccctcatccagggttatgtgagttgggtggagggtgtccccaagagatgtcaggctgctgttctgggcagaccaaattcaccattcaaggtcttggtttctggcttggtgccttctccctgacctctgcttcttgactcttcaatgagcagaaagaactaagggaactggctgggcatggtggctcacacgtgtaatcccagcactttgagaggccaaggagggaggattgcttgagctcagtaatctgagaccagcctgggtaacagtgagaccccatctctatgaacaaaacaaaacaaaaacaaaaaaccaaggggtctgatatttcccccacttcccagagtgctgttgctcttctgtatatatgatgatcctttatctttcttgttgggtattagagatgtgcagtttgccagaaacaaagcagatgaggtcttggcctatttggctaaaacaattttgcactgttgaaaagtagacaaagtagaaaaagggctaaaaggaggagatgtagcatctcggaaacaggtaaacctctcttctgctggaagtctaagttggataaatatccactgtaaactggaactaagcttttgggcacattggttttagagtatttgacttgaaagtttttcttgtgtgcaaatctgtatgtgttttgtgggggctctcaggtgtgaacaagagatgacattaggatgtctgaggagattctcggcatgtgaatggggccactaggggaccttggggggtgactagcagagactagagcagaagtagggtgactttggagaggactggggtgaccgtggtgtcttggataactttgagggtgctgttgagggtgtctgggagtgaaactgaggatactaacatgagttgttatgagacaccttttaggagttcaagtagggtgaccaggggtgtctgtgggggtggttctagaaatgatcgaggctgggctcagtggctcacgcttgtaatcccagcactttgggaagccgatcacctgaggtcaggagtttgagaccagcctggccaacatggtgaaaccatgtctctactaaaaatacaaaaattaggctggcgtggcagcagctgcgtgtagtatcagctaatcgggaggctgaggcaggagaattgcttgagcccaaaggcagaggttggagtgagccgagatcacaccactgcactccagcctgggcaacagagcaagactccatcttaaaaaaaaaaaaaaaaaaagaagaagaaagaaagaaatgattgaggtgattctgtggggtaaccttgaggatgagtgggatgacctttggggggtcctctgtggggtgaccttggggggtgtgtgggattatgagagtgtctgagaattgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttggagggtgaccaagaggggtatctggggttgactctggggcccctgtccccctctccccagttctcatccatatgagcaagggcttcatgttactggccgtggccctgtgctgagtcctcctcccgcccatggccctctcctcctggccagtggtcctccgcctgaacatggccgactttgtcttcagtttcctctgcctcggcattggtaggtgttggcttggggggcgggggccctccctaaccccagccctgctctctggctttctggaggtgtatctagacttccgtgctgctcccctcggggcctctgtcttagcatgtctctggggagctctgactcagttctactctatctgtgggatgtctctctctcccccactctctgtttccctttctttttttgtcccctctctccaggtatctttctgtctgttgtgagggcgtgtgtgtgtgtgtgtgtgtgtgtgtgtgtgtgtctgcttgtcacggagggtgggagaggatgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacctgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacgctgactccgagcgcaccccgggccttcccatttcatacaccctcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatatcaggccacgccctccgaggggaccggtggcaaactccagccctcgctctagggcccgccctttgcggctttgtccctgcccactgggtcctcacagtacctccaccccagaggcccagcatcccctcccgttctgcagacacttgtccagcgtcccgctgagctcggcagtgtggctagtttgtgtggccctgcccctggtgcccagccagggtggtctgcatggaacttctttcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcagaccttccattgccccccacctccccaccagggcagggtccatcctagtgtgagtgaactgttctggcgtccctgacttgccctttgggatctgagcctttccctgcctgtttgtctgcacctgtcacagccccttcctttccccacctgctggtgacctcagacttccaggcatgagattgacacagctggggtggccccagcctcagccgagtgggtccaggtgcaccacatctggaaagataggtgatggcagaacgtgacacacattggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcaccctgggagcacaaggtgggaggggagagtgagaaaggtctacggggcccaagttctgcctggggagccccagctcgcagacagggcctccagtgcccactcccagaggaaggtgggcagggattcccacagaggggacagggtctccagtcctggccaagggggaagggacctcagggtccagctcctgcacatggggcagggtccaggtggacagtgcctgcagacaggttagggggaggaggggcaggaccatctgcaggacgctgcccctgcgggcacatcgcagaggccacctctccaggactactctctgactcgacggtaacaacacattaccacgaggaacggtgaactctggtgtggggggtgagatgcagttgtccctggatgggcgggggaaggagggggagctggggcactgatggggcgagtggctacagctagctgggaagcagtgaagcagatgcctggttagctctcagaagccagttcagaggctgagtcccctccctcagcccttccagaccctgggggcagggctgcctcaccacacaggtgtctttgccaccttccaggtgtccgacacacagcatgaagtctgtcaccttctggacgtgggcttttttgcactcatcattaggcaggattttgaggtccacacactggagatcatctggaaatgagactacgaacccgggagaaaaagggctgcagcccgacctcacctgcttccctggccctttctcccttggacgcaggagtccccatccccgccttgggctacacagtctgcccccacatacaattctctggttcgatgctgccccagccggaagccaaacaggtgctccccacttcgggttcctcggtgggcaactccacgaccttcacagcatctgtgatggtatcagcaggctctgtcaggcggagcagcatgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggcgacccagccagagctggtaattgctggggaaagatgggaatggagggatgagaagacgggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagattttgagagtgcaaaaggcaaatgaagagacagagcaaaaaagagctcaaaaggacagaggggtgaaaaaggcggaggggagggcagtgagaaacagggtgagcaaaaaagaggcagatgagaaggataaaagacagggacagcgagaaacaggcccagggaagagggaggaagagggaacagaacacggaagggagcgagaagcagacaaatgaaaaaggacgcgggacgtcagagtgagaactagaaacagaggcagagaggaagcaggagtgaccgagtgtgggagagaaaagggagggaggccctgggggagggtgggggcaggtggggagggtgggggcaggtagggaggaggggaggcctgagagcggctcagctgcagctggggctgtggtgcgggctccccaggggcaggtggcctggcctgaagtccaaggtcgaggcccccttcccttcccagcaccctcccgcgcgtttctcgccccgcctcctccttcctcctccctcagttgccccacccagctcccgctgaaaccagcccttccctgtgtctctccagagtggagggatatcctgtggggcggggagctggacagagggagaggcgccccctcccaggcacacaagttggggataaagcccttcctttactctggggcctcccttaggtccatctgggtgtgtgtttagtagggatgagggagcggtgaggtagagacccagagagagagagatgggtagagagatggagggtgagacacagtgacagagatgccgcagagagactcagagacagacagagacaggggagatgcagagacaaggagacagaggagagagaggaagacagagaccagaacacagtcacacagagacacaagcagaaccagatcccaagagacccaggcagccttggagaggggtgtccagcccagctctgccctgccaggcgacctgcgccagagccttcctctctgcctcagccccccagtcttgcctgaggttatccaaggggaatgccactggcctgtcaatcctgtggcagcatagatgccctcctcccagaccccaggcccctactcactcgctgatgcaatgagcagctgtgagcacccactggcggtgcaccaggatgcccccacactggaaagtgctgaaatggtacagagccgcctgccagggctgggaatgctgctcacactcccagcctcccacaatccgggactgaatcgggggcgcagcacctgcagaggcggtgctgggtcaggaagggcagggttggcaggagaggccagggacaaggctaggagagggagctgggctgtgggtctgaagggacattgcgggtagaggaccagggctggaggttggggacatgggcaaggggtgttgggaaggggtgggactctggactgttccctgggcttttggagtggtggctggacctggtggggagattttgtgctctgacagtagagcagcctccagggatcagggtaggagacaggagacagtgtctggagcagacactgcatctgggcgtcaggtcatttggggtctggggctgggggatgggaggtggtgggttaggggagtggaaagggattctggaaaccagggatcaaggcgccaagggtgggacaggatcagaggctcactgaggaagaatctggagggctaaggggctcctaggctagggaaacaggacctgggttgggcttttgaggttcaggaaaggatgcagctttagggaaccaggtctgagaggtaaagaagagcatctggactgaagagtttgggggtgacttggggtccctacattggggttggaaggggccagcttggctgggacagttagatttcagggcttcctggttaaagggtaaaagaaagggctatggttaaggctagaggtgggcttccgagaggttttggggtccttcctgtgaaccaggaatggcaatctgaggggaggttggggccctgagaacacagttgcggtcaggactgggacggggctcaggaggagggaggcgtgagtggcagtccttctcggacagggtgaaggatgggatcttcgtttctcatggggatggggttcatggtctgagggtactggaaggatatggggtcctcttggaggcaatcctaggaagaggattggagaagtggtgagaacaggcgccaagcagctgtgggaatgcaatgcaggacccacttgacgtgaggttgtagaatcacatactgacttgggggaggccagggcagaagcgctggctgagaaggcattcaggatccttggggtggggttccagaaaaccagagctgtgtaggaacaattcaggcagagaagggctggggcctggggcgggatggaacttccccaaggaaaggagcatgtggtgggagggtgtggtgtttttcctgggagagctgggggtgctgggtgggaagggacatttgcagacccccccccataccagatgggggatcccacatgccagtttgggaagcagggttttctggtgaaatttgggggaccctggaaggactggggagaccagatgtcagggtctggaggacacagttgagagcggacagctggatggaaaaagtcactggagtgtggtgggatttgtagactcaggagccaaataggtggccgcagggaactagggggcaggaggggatgatcagagtcctgtggggtgggggaagcccatgggagggttggggtcctccagagagagacagagatggcccagaatctgcccctttggtaaagcggtgggacagggcgttggctagggaagaggagaaagtactgaggcttcctgggaggagcaggaatctggtgtgggagtgagcactatgacaacatggaggagcgggggtggaagtttagggtggggccgcgcaagatagataagagccggggcaccccggactaggatagactgtgggccagagggatgagggtggggtgttggaggggaaggtcttatcggggggggatgtgaggccagcaagagaatcagggcccgttccccctcccacatccccccactgtctcaccagtcccccccagggacagggcgaggcacagaaccaggaaccacatggtgacagaggtgtccaggggccagcaggtggaggaactggggaacctccctggggaggcttttaaaagcccttatcccctcagagccccacccctgccctgctggcacccagatgttggccaaggcccttcccctgttgcctgggggctggacaattgccccccccccctccgatccccagagctgtagacggggagggagaaccagcacctgttctgcaggccctggatcacgctggacgcattcctggggttgaagccaggtggggcagggcctgtggctctggggctttgctctggggagcagccagtgaggcaaggggggactgaggggaagcagaaacaggaagacggaggaatcagtgacccctggtacaaagccccatatacctcagtctcaattaaggccctgcacccccagacctggtgccctcaaacaccagcagttagggctctgattccctgcaccactcggagccaagatactagcatctcagctgccagttccccctgaaatataagccttggccttcagaatgccctggttcttgcactcccagacccaggacctaggtccccaaagctactgttcctttcataataaaattttggggtacacatcaccacattcctagtgcctccagatccaggaatgtgaagtttcaggggtctcccagggtaagttctttagcattacaaaatccagtgtccctcccaaacaatgctggggtctcaatgagcctcccacttcttgctcccagttatgggtgctcaacgtcctgtcctccaaagtcccagagatctggacaaccttccctcccaggtcaagatcaggctaaccacagattccaatgacccttcccccccaccaccagtacaatatttaggtctcacgagccaggttcatgtacttcaacattcagcgaccttgaacatcacattttgtggtctctgaagataattaggaactagattcctgcagcctcaatggtaaacccataggcttccaacaggttgtcttggctttttggtaaaatcaaagcagctcagagttccagcctctgctgtatatcagggacctggctaaggaaaggacagtatttgcctttttgccatggctaccaggaagcccagaactaaatctttttttttttttttttttttctgagatggagtcttgctctgtcaccaggctggagtgcagtggcgcgatctcggctcactgcaactcctgcctcctaagttcaagcgatcctcccacatcaccctcccaagtagctaggattacagtcgtgtgccaccacgcccggctaaatttttttagtatttttagtagagatggggtttcaccatgttggccaggctggtcttgcactcctgacctcaagtgagccgcccgccttggcctcccaaagtgctgggattacaggtgtgagccaccatgcccggcccagaactaaaccttaaagaaaaagccattcttggtaatctagtgtctgttaggtcctttaactgggatccagagatagagggtatttactcagtgccagacacgattttaatcagttcagacgaatcatctcatttaatcctcacaacagccctttgaagtcagcaataagatggtctcattttacagataaggaaaccaaggcgaagtgagattgggcctcttgttcaagatcacacgggtggtcatgtgtgttgaatgaatggagccctgcttcaagccgcttctcctcacctagggatcggggtggtgggtgaaaaggaacagtgtacagtgtctcggggtttctctttgaccccagaaaaaagtcacagaaattcctacagagcaacttggatcagcgctttgttatcttggcattaaacaggtgaccttgagcgccagctttgtcctcaggtgggacaagtccttggctaacatctgggccttggacagggtcttgggggatggctccgttctgttccatgtcaggcggggctgctggccagctgtgggggcttctgctcagtcaggggcacaggagataggctagaatagtcagttcctcttcatggtttccctgatccactccaagtagtggcagactttggtatagacaccaggcttggtggtgttgtcacaagggacgtcaccccaggacacaatgccctgcaggatgcccccacagaccaggggtcccccagagtcaccctgtggggaaaagagggggtctcaggttgagtgaaacctcctggattcatcctcatcctaatcaccatttgcaatctcaccccaaacccaatccatccccatcccagggaaccccaacccaactcaactcaatacagcccagtttatcccaaacagagccaacccaaccccaaccccaaccccaattcaacacagctcaatacaactcacccaacctatatccaatctcacccccatgcaactccagtgcaactgtactaagttaaatccaactcagcccacatcctcaccattcaaaatcaaatcaaacccatgcccatctcaaaatccaatctcaatcttcatgtcttctgcattccaaacaaaatctacctcatcccaattcaaccctgacgtatttcccacccagaatcaaaccaaaccattcccattctcaaccccaacccatgccatctcaaactaactatcacattatccacctcaaacaacgcaatccccacctataaccccaactccaacctcacccctattctaacttctcttcctactccatctccaagcctaaccctagcatcttctctggcccaaagcaaagaaaatccaaccccatccggactcccacacctgtccccatccctcttcttccgcctgatggcccctctaggctctgacctcacaggattctgcgcctctgccctccgcgcctgcacacaccatggtgtttgtcaggcgccctgggtagctcttgtcacaagatgtgtccgagataatgctgatgttggcacaatgcaacgtatctgggagactcactggggaagacagtggacttggagcagatccataaattccggcccttgtcccctccgcccaagagccctggagcataggattccttgaggcctcgcatccagctccatcctttcacgcaccttgtgaccgggggctcccagcggtcccaggctcgttgtgggacaccaggccccagccagacaccacacaggcctcccccgggtgggggcaacgcgtgggtagcaccgcggggcgcacctgggggttcaggcgtgcgggctggactaggcgcagcaacatgatgtcgttgcggtggctgcgcgcttcgtagcgcgggtgtggaatgacccgagacgtggtccgtagttgctctgggccatcgcgcttgcgcaggttgtgctctcccaggcgcactctcatgaagctgtgcgggcgagtggttttcccgccagtggagtgcgggccagtggttacccgcaagtagaggacagaaagatcaaagagtgggcaacccgaggtctcccgaccctttagaaatctcgacatcccattaccttttcccaagaccctgaagccaatggttccagcccctgctcctcaaggaccaacgagtctgaagtcaggcacactcctagaactcgatcccctccaactactcccagccccctcctggtctgtccccgaatccaggattctcacatccctagaactgaggctcaaaagctggaactagtcttctccttcctccttcagagatcgaaggctttgaaacacacactccttcctaacccaggggcttgacatccggcctcctcgtctttcagaacccaggagttctggcgtctgcctccgtcttcccccaaatctaggagctcttccccccgaaccaggctccctcaggaccctgagcccctgccttcataccggctttggcagtgggccgcagacagcacccagtgtggggagatgagggaagcgccacagttaaagcgtccacgctcgtagagagccacttgccatggctgggagtggggtgcacactcgtcaccttccagcaacttgtcaccatcctgggctgctaagagaaggggtagaggatgcctgaggacagggacgtttacattgcctcctacaccttccttgcaccctgccctaactactatatgcctatgcctttcccctaacttctcaagacaccctgccctgtttttgtttgttgttgttgttgtttttgagacggagtctcactcttttgcccaggctggagtgcagtggcatgatctcagctcactgcaacttccgcctcctgggttcaagtgatcctcctgcctcagcctcccgagtagctgaggtgcccgccaccacacctggctaatttttgtatttttagtagagacgaggtctcaccatgttagccagggtagtctcaaacttctgacttcaaatgctctgcccgcctcagcctcccaaagtgctgggattacaggtgtgagccaccatgctccgcctgccctgttgtttatttacaaccgctgcctgttttctccagaactctagcccccaccccatttgctataagactctgggagagagaggaaggggaacagaccagagggcaagaagtcctctgtggttgggggtggagacaggggcactggatacaggttcagacaggtggtcacttgaaaccagtcattcacggtcaccaaattgtcacagacgtcaaacgcatgtggccactcagtatgtgtgacccagccttggccccagagtctggacatgtcagccaaattcagtgtgcagtatgagtcccagatgtggctatacaaggtcatggacatgcatacatgcacatccagcttccacacttaggtacagctatggacaggactggaagctgaaattcacttgcatgcacatgggttgcagcttcaagaatcacagcacaggctgggcacggtggctcatgcctgtaatcccagcactttgggaggccgaggcgggtggatcacctgaggtcaggagttcgagaccagcctggccaatatggggaaaccctgtctctaacaaaaatacaaaaaattagctgggcatggtggcgggtgcctgtaatcccagctactctggaggctgaggcaggaaaatcgcttgaacccgggaggcggagattgcagtgagcggaggttgctccattgcactccagcctgggtgacaagagtgaaactccatctcaaaaaaaaaaaaaaaaaaaaaaaaagaatcacagcacagatgttcatatgtgtatatgaatatggatggttaagacatgaatacatacacacacacacatgcacacacaaacacacacacagaattggatattgttcagacctaaattcaacatctctagtgtgagtcttggcatccagtgtcacagacacttgcatacagggtctggacaaagatgggtccttaagcctgggttcgaatgtactagctgtgaaactttgagtaagttattcgacctgtctgtgcctctgtttcctcatctgtaaaatgaagattgttgtaaggatgaggtaggaatgtgtatgtgtgtgtgtgcatgtgtgtatgtatggtgagtgatacctagccctggtagctacttaataatattagttgttttttgcaaatgacacctggatttagtcacagggacatacgtgtgaaagttcaggtccatcctggagatggccaacataagtcagacatctgcacagaattacctataataaatagtcaaggttggccaggtgtggtggctcacgcctgtaatcccagcactttgggaggccaaggccgaggtgggtggatcacctgaggtcaggagtttgagaccagcctggccaacatcgtgaaatcccgtctctactaaaaaataaataaataaataaataaaaatacaaaaatcagctgggcgtggtggtgcgtgcctgtaattctagctactcgggaggcagagacagaattgcttgaacctgggaggcggaggttgcagtgagctgaggttgcaccactgaactccagcttgggcggcagagcgagactccgtctcaaaaaaaaccaaacaaacaaaaaaaagtcaaggttaaaaccgtgattcacccacaagacattttgtagagttagagctgcagacaccaacccagaaggccaacactcagatgtggacttgctgtctggggcagcacccagacacggggctgggcattcaaggtcaaagacatgcagctgaagccagaggcagccagggcaggacatatttatccatctctagatcagcccccaagccagatctgtggagtcactgattgggtttcacatatggggatctggctcatgcatgtggagaggatgtgaacatacagggccttgtatacccactgcacacgtgcatgtacacacacacacacacacacacacacagaatggcattatgcttaaggacatgattagagacattcaaggtcacaggaccaggacccctctccactgggcaatgtggatgcatcccctgaaggttgaagccatgcacactcccacccacacaggggcaggatttgcacagccagaccaaatgcccacactctccccatcacagtcaggaactgggccaaaggcccccgtgagaccaggggaatgcggatgtggtggacaaggggcttaacaaaggaagggtgaggtcgtcctccgaagggcggagggtacgggctgaacagctgggcaccgaggctgcacctggccagtccaagccagaggaaggtggaggccccagctgggcgcagcaggcaggcgcgaggcaggtaggtgagtgcacagagagagccggaggggaggctggaggcgtgggggtctcaggggcccccaggagtgagggtcatttgtggcagaacgttaatgaaagtccaccccccaatttctccagaagagaggcatcaggttacaattaatttcttggtgtgtggcagctgagttcaatctggagtttgcctgacacccaaggtgaccttgatgttgtggccgtccctctgagccacagccccttcccttgtcaaatgaggtcggtggtgcccaccacacatagacgttgtatgtaagctctaagcaccgtgcctggcttgcacacctgaaggggcactacctgggccaggcttatgcttctgcctcacacacaaccacatttaatcccctcaaagaccctgtaagagacagggagtggcaggtgtgggactcaagctggagtctgtctgtgctgttggcctctcagcacttgtctaatgcttgctatgtatattacctctgttatgctattgagacctcactgttattgtctcaagtgggtgctgtcttatagagaaggcattcgaagcccagagaggtgaagcagttccctcaaggacacacagcaaggaagcggttgccccaggactcagctcaggtttgtgtaaccccaggaccgtgttccttgtcgtgggcagcgagaggccccaggcaacatagcgactccagagcagcagcaccagcacctgacggtaagggcttagggacattggcacaggtggagggtgaaggaaggatctttagtggtctctgggtgaggtaggggctggcagatcactgggcccagacatgcttgggaagggggcacctgctcccacagacctggccccctcctggggccacctcacctgtggatgccagcaggaaggagagagtgaggagaagccacattgtggaggagggaccagggttcggctgcagtctggggagggagtgagagaatccaggtgaggcaggacccttctgcctccaccaggatccctccagacacagacttatcccatccactgttaataaatttcttctgaccaccggtatccccttcccccaaccccactctgcgcttccttctgggtcccccatctctggaaggtttactcttcctctaggcactcggacagaccctgccccacctcctccacctgtcagcctccagcaccatgctaccagcccctggatctctctccatcatcaccaaggacccctgtcccaacttttttttttttttgagacggagtctcactctgtcacccaggctggagtgcagtggcacaatgtcggctcactgcaagctccacctcccaggttcacaccattctcccgcctcagcctcccgagtagctgggactacaggcgcccaccaccgtgcccggctaattttttggaaattttttttttttaagtagagacagggtttcaccgtgttagccaggatggcctcaatctcttgacttcatgatccacccacctcggcctcccaaagtgctgggattacaggcatgagccaccgcgcctggtctatctcaaccctcttatctggccttttgggtccccctccagtccagtcccctccaccagcttgccctccagccatgaccccaaagggtctttctacatctggagctggctgtgcccctcccctgctcaccaccctccatggatccttggcaccaccaggataaagtccagctcttcaaattcactttctttctttttttttcttttttttttttttttttgagacggagtctggctctgtagcccaggttggagtggagtggcgtgatctccgctcactgtaacctctgccttctgggttcaagagattctcctgcctcagcctcccaagcaattgggattacaggtgtgtgccaccacgcccagctaatttttgtaattttagtagagacggagtttcaccatgttggccaggctggtcttgaactcctgacctctagtgatccacccgcctcagcctcccaaagtgctgggattacaggcatgagttgcctggctccagcctcactttcaaggacaaaagtggcttcttcccttccagcccctctccctgggtctcccatgaccttgtcctagacgcagccagtgctgccattttccctcctgccatttcatgcttaggctattcctcccaccgcatatccaacgccattcccttccagccccgcttcctccttgaggccttctctgacctcccctgaccctcagtggtgtctgcctcccctacgagactggcagctccccgaggagctggtctgactccactctgggtctccagtactgcagggcccgacccacgggaggcctcaggaagctttgagggtgaattgaaatccttcttccccatatcttccaaattcatctttgtcctctgacactctgcccccacctcttctgggaggccccaacacctaacaggtgtctcccctgaatcccacagcacccattctgtctccattacagcgcagatgccccatacttgctgaggtctggcctgttcttttctccatctgggggtcttgaagatggggctcaggtcaggttctttctgtgacctcagcactgccccacctggggcctggtacacaggaggcctccgggaggttgtgctgaactgacttgaacccgtgatcactcctgaccacgttcttggctctgatacaagtacttcagggacgtcctcctgatccactccatccccctccctccccaccactgcagctccttctggccattccaggacattttcttggttcaggttcaatttggggcattggtaaaggacacgtggatctacccatgcccttgacactcagttctccaagcgtggtcaacgtttccccttgaaaccagggcacagtgaatctcccctttgcccctccctcagtcttgtctcaaagctctcacctcctccagatcctccagcagcatctagggcagcttgggtgccagaagggagcaggtaccaggatgcctgaatttataagctcccagtcccagctgggtctgggggtgtggtggtgtagggtggggtgggaggtggctgagagtcaggtttacaggcagagacgccttggttgctggtggggtgggagacttggcctaatgagcatttattaggttgaagctgttgtctgagtccacaaagaggaattctccaccaggagcagttcctcaagggggaggggacaggaggacaaaaacagaaattaggaggagatcaaaagacagagtctggaatttggggtctggagtgtggaaactggatcctaaagtccctgttcttgggcttggggcagagttctggatcccgggttctggatccggatctggttctggatctgggtcttggattctggatttgaggatcttgagttggagattaatgacctgcagtctggaatatggatttcaaagtctgagttcttgggctgggggtctggaatctggatcctggagtcgggcctttgagtgacagatcgtgaaccttgattctggatcccggggcattcgaatctagaacccacaataggagcctggaatctggtgtttggaatctggcaatcgaggctggaaacctttgcacctgctatgagaagcctggggcctagactacaaatggtagatttgggattttgaattgtggggtctggattctttttttttttttttctgagatgaagtttcgctcttgtcacccaggctggagtgcaatagcgtgatctcagatcactgcaacctccacttcctgggctcaatagattctcctgcctcagcctcctgagtagctgggattacaggcgaccaccaccacgcccagctaatttttatatttttagtagagacagggtttcaccatgttggccaggctggtgtcgaactcctcatctcaagtgatccacctgactcagcctcctaaagtgctgggattacaggcgtgagacaccatgccaggcttggggtctggattctacagggtggatctagcctctgagctttcaggagtagactttggaacatacagtctggagtttcaaatctgtttttgcattgaaaacctggactgtggctgggcccagtgactcatgcctttgggaggctgaggtaggaggattgctggaactgaagggtttgagaccagcctgggcaacacagcaatacctcatctctatgaaaaatctaaataaataaataaataagtaaataaatttttaaaaggctgaattgagagacagggacctggctttcacgattctgagattgctagaatcttgactctagagtctgaatttagagtctgggaacccagggtctctattctggtcctgtagtcttatttctgggttctagagcttgaaatctggattctgcatcccagaggctggagatgatcactgagatgacccaaggctttgggtatttgaggctggcttccaatgtctcagaaccccagagggccccaagcaattatctagagtctattttggcttaattaatgaggaggtcccaagacaggagggactgacctcactcaggtcacccagtgaaggatgggacctgttgtaagcgtggtctctccccatgtgtggaaagtcatcatctttatgggaaggattcagccattctagaactacaggcccctggaatttctagaatatcagactttcagattctaaaagcacaggccctaagacattctggcagtggaggacactctggaaggtaagattttagaatagcctagaaccacagagctccaaacactctagaaccttcgaacatcgggcactctggagtccccagaaacctcatgcattctagaacgtcgggtctccagacattctacaagcccagaccggcagacataatagatccccaggttggaagctattctagaactcctatgtccctttgcctccctccccacaaattgatgctcaaagtctgcgggcctcaccctgggccaccgcttcagctgagcagccctgtttatggaatgcggctgcaggccactcctccgtgccaagtgctctctttgtaggatctcactccggctcccggcagccctgtgaggtgtttatattaataaccttatggcttcctgctgaatacggaggaaactgaggcccagacaggaggcagcacaagcaaggttcctgcagaagcgagaggccacgcgggagaggaatcagtgttccgactccggaacgcccggtgggccctttcgccgccacccctgcagccgcctccctctgttggggcgcggtggtgacgagggaaaggagccgagcccctgggacttcctcggtgccaggtctgtgctgagcgcttcccgtcacgatcgcacgtgctcctcctcctaaccagcctaggcaggtactgatgaagcacccctgatacagacggggacactgagggcgctcccgccgcgccgaacccaggcgcgcacccggtctgcgctcggctccctggagggcgcgcagccagcggctcccgcagccccgcccccacgcggtgacgtcggcgccccgtccccgcccactgtgtctggctcaggctcgcgcgatcgatgtcctcctggacgtgtccgcggacgtccttcacctccaccgcggcctgggtcccgcccaccgcggcctgagtctcacttttgcccggctcctcctcctgagaacgttccctgggagtttttcatcaactcccgtggttcatccaccaaccacgcaggtctcctccatctgaccctgaactccggcttgggcagccacctgctcctgggcgccccctgcaccactgtccctaggcccctctcacttaccgagtcccaactcattgctctatttccccaaaccctccttccctgttcttccacgttcttcatctcaggggcagcgtcaccgaccacccagttattcggccagacgcccttggcactgaccttgccccatctctccccttatcccctacagcccatcggtccccagccttgtcccttcggcccctgcctctctctgccccgtcccctcctctctgtccccttggcctggctccagctcagacgtcctcctctctctctggaccctcgctcctcctgtccgggaggacagcctcctgtcggtcaccacgtggccctagagggtctctctgcacttggagatcaccccgcccctcccctgctcacagccttcccttgcagctccccatcacccctgggcaaggtcccggcttctcggtctgcagttttaagccctttgagattccccagcaggaaaaagcctcccctcaaacccccttctcagggggcctgcagactgcccacctccggagcgggactggactcgtggtgcccgaagggcctccccatgaggtgctggccctcttctaacttagtctcaccacggcctccgttccttctggaaccagacaagctgctgtttcagggcgctgggtctggatccagacagcatgggtgcagatctctgttccactacttactattttgggagaccctggtaagagttttttcttctctgtgtctcagtttcttatccttaaaatcagaggatcccctcgtagagtttttcgaggagtaacgacttagtttgtgttaggagctcagagcatatagtaaattatgacgattcattcatttaacacatgagcagacgggagtgcgggggtcactggtgaaggtcacccaggctgcagaagtggaatcaagagaatggttctcggggtcctggtgccccttgtgagaagcatcagctctctgggtgtcaggtgctcatctgcgaaggggtcttccgttgcggtggggtggaaatgggagggacctcacaggggttggatgaggtcatacccatggagcaggtgtgcgaatcataaaatcaggctgaggcttgcaagaccggttaacacggcacgtgattcagatgtagccgctggagccaggtggcccgggtttgagttctgcctctgtcccataatactgtgcaccctcaggcaagtcacttagcctctctgtgcctcagctgcctcaactataaagtgggggtaataattgctcctccctcttctgtgggagtgttttgaggtgttcattcttgaaatctgtgcccggcactgagtgagtgctgggccattatcagtctgtcctattacccttgggaactgaaagctggggagggatggttatgtggggtctttctcagatgacacagttgggtagcagcagatttggcactggaagaagccactgtgctttttgttttgttttgttttctgttttttgtttttttttttttttgagacggagtctcgctcttgttgtccaggctggagtgcaatggcatgatcttggctcactgcaacctccgcctcctgggttcaagcgattctcctgcctcagcctcctgagtagctgggattacaggcacccaccagcacagccggctaatttttgtatttttagtagagttggggtttcacagtgttggccaggctggtcttgaactcctgacctcaagtgatccacctgccttggcctcccaaagtgttaggattacaggcgtgagccaccgcgcccagccagaagccactgttttgatctcccagatgtggtatctttttctgaatccctgtgacccctttatcaagacccctgttttacagatgggggaactgaggcccagggagaggaaatggaggtgtgagaccctggtatgagagtgtgacgtcaagcaaagagaatgtcacacgcagacgagttcttctctgagactttatttcctgggctgtgctgggggaagctggaggggaggaggcagaaaaacccacatcttctcttcttttgtcctgggagggccttaccgataggtggcatcaattgtgcgtttgttcatagcagttttactcctgggtctgagggaggaggggctgggggcctggactcctgggtctgaggagggagaggctggtgcctggactcctgggtctgagaaaggagaggctgggggccgggactcctgggactgagggacgggtggctggtgtccaggactcctgggtctcaaggaagaagggctggggggtctgagggaggagggggctggggactcagactcttgggtccaagggaggagcggctggggtctggactcctgggtctgagggaggtgggactgagggcccggactcctgggtttgagggagaaaggcctgggggatctgagggaggaggggctagggtctgaactcctgagtctgagggaggtggggctgagggcctgcactcctgggtctgagagaggaggggctggggggtctgagggaggaggaggctggggggtttgagggaggtagggctggagtctggactcctgggtctgagggaggaggggctgggggcccgcactcctgggtctgagggagctggggctggggaggtctgagagaggtggggctggggggtttaagggaggtggggctggagtctggactcctgggtctgagggaggaggaggctagggacccggactcctgggtcggtgggaggaggggctggggcatcttagggaggtggggctggggcctggactcctgggtcctgcactctggggctgggagagaaaggcctgccctgcctgcgtctccctctctgtgttccacccccacccatagacctcttcgctagagtcctgagcccccagcccactttccagctccctcctcttccctttctggaagcttcccttctgcgtttgttcataggaggtttgctcttgggtctgagggaggaggggctggggtcctgagctcctgggtctaaaggaggaggggctggggagtctgagggaggagggaggtggaggcccagactcctgggtctgagggaggagaagctggtgcctggactcctgggtctgagagaggagaggctgggatctgggactcctgggtctgagggaggaggggctggggtcctggactcctgggtctgaaggaggaggggctggggggtctgagggaggagggagctggggagacgtgtgtcttctccctcccgtgactcctgctcactttccccatgtctgtgtttctgctcccctctccccgtgatcctgtcagcttcttttagtttttattttttagagttggggtcttgctctgttgcccaggctggagtgcaatggtgcaatcatagctcactgctacctcaaactcctgggtttaagcgatcctctggtatcagcctcccgagtagctgggactacaagtgtgtgccaccatacctggctaatttttacgttttgtttttttttttgtggagatggggtcttgatatgttgcccaggctgagattgtaaaaagtcatcatggaacaccccacctcccagtgcaggaaagctggctgtggtattgccaagaatgatgtttattgcagcactattcccaatagctaagatttagagacaacctaagtgtccatcaacaaatgaatggatacagaaaatgtggtacatatacacagtggaacactattcagccatcagaaagaatgagagcctgtcatttgcaacatggatggaactggaggttatgatgttaagtgcaataagtcaggcacagaagataaacttcacaggttctcatttatttttgggagctaaaaattgaaacaattagccgggcactcacacctgtaatcccagcactttgggaggctgaagcaggtggatcacctgaggtaaggagttcaagaccagcctggccaacatggtgaaaccctgtctccactaaaaatacaagaattagccaggcgcagtggcgcgtgcctgtattcccagctacttggaaggctgagacacagaagtgcttgaacctgggaggagggggttgtggtgagccaagacctctccagtgcactccagcgacctgggagacagagcgagactccatctccagaagcctggagaaatagggacaaaaaacaaaaacaaaaccaactgagttaatggagatagacagtagaagcatagttatcagaggctggggagggtgagggtatgtgggtagtggggaagtgcggatggttaatgggtacgaggaaatagaataagatctagtattcgatagcacaacagggtgactgtggtcaataataatttaattgtacatttaaaaacaacaaaaagaatataattagattgtttgtaacacaaagggtgaatgcttgaggtaatggataccccatttaccctcatgtgattattacacattatatgcctatattaaaatatctcatgtaccccataaatatatccacctgctatgtacccacaacaattacaaattagcaaaaaaagaataatgtggctcttgccaggtttcagctccacccttgctgtgtgtgtggcgcgttgcgtccccaggtccctctcagtggtccgtggagagcattaccacctgtcactgtctactatctcagggcagaccctctctcctctctcttcctccatctctgcaccccacaaataaagtggcaacccccccgatgtgtgtctttgcagaacctgaatgtgatgagattgccagaaaatgccagtgtgcccctggatgggtggaggagggtggggcgggtggaggggacaactttgccccattggggaaccactgggctatacctgtcactgaagcttcctttctcccctgcacctgactccacacctcaggacgcaggtcaggagggctgggggatgctctagccttggccaggtgggcctggagatgattgttcactgcaggagcattcacctttttagatgggtgcttcctgtctagagaaggagacacggggagctggaaagagaagcctgcagaaatagggaccgggcaaaaacaaagga

SEQ ID NO: 1126 - DNA, 78248 bp, Homo sapiens
cctgccgccccactgacgctgacttccggacctgcagaactgtgagaaagtacgtttcgcttctttgtaaactgcctggtcagtggtggcagcacagatggaccgacgtggacctcgacgcgaatggcgggctctgggcgctgacccggtggcggcgtagctcaccgaacacccagggggaccagaactctctgccttccactcagttgtgacttgtctatttttaaaatgttaaaaaaaaaaaaaacccacaaggtgcagtggctcacacctgtaatcccagcctttgggaggttgaggcgggtggatcgctcaagctcaggagttcgagaccaacctggcccacatggtgaaaccctgtctctaataaaaatacaaaaattaaccgggtctggtgacacatgcctgtaatcccagctactcaggaggctgaggtaggagaactgcttgaactcaggaggcgggggctgcaatgagctgagatcaagccactgcactccagcctatgggatagagtgagattccatctcaaaaaaaaaaaaaaaaaaaaaaaagtttaaaaaaccctacccctgccaaatgcttttccgaagtagccgtgccattggtgtttccaactttgcctggcaccttccatcgtttgctaagttccagcaggtgtatttcatttgcatttccctcatgaataatggtgttgagcagcttgccatggtgcctttgctgcctgtgacctctttggtgaaacatccggaggtgtcttctgcccacgtggaggcgcagcctgggctctgccgcccacctttcacccgaggagcctgcagcacgtggagagcatcagggtgtgctttctttacagtttggggcttttttgagacagggtctcgctctgtcacccaggctgcagtgcagtggtgccatcacggctcaccgccagccttgaccttcacctcagcctcccaagtagctgagactacaggcatgcaccgccatggctggctcttttttaatttgtctttttctaaagacagggtctcactgtcttgattaagctggtcttggaactcctgggcttcaagggaccctctcagctcggcctcccaaagtgctgggattgcaggtgtgagccatcatgcaagtctggggttgttttttttttgctaaacaggatgaatagaaatctcttttgggggatctcttagtccaaatcctttagctgaatgcgcgtgtcccggtgaggctgctcctctagatgctgcgggcattttgcagacgtcccaccaactgccatcagcgaccaattagaagatagggacagctgcacatgtcacacagcccttctgaccttgtgtgtgcttcaagtccgagattcctgacacaaagcagcgtgtgcccccccacccactctgtggccacagctggagtcctgggctgctgggtgctccaggtgccataccccacacacgcatagagcccgtgggctggcagcgggcacccacagtggcctctgcaaagcctgcctggctgcggctcgtttcctcactgcagcatgctcataggaatgtgggagtttcgcttgaagtgtgggtaaagagttctggggttgtttgagccatcccaggccacagggcctccaggaagtggaggaaatggtaaatccagggtcctcttggccactgcgttggcctctgcacacttggcccctgcggaccctggggcttctgctttactgtctgtgacataaacaagtgacgcttgccaccttcttgccgggaaagccaggctgggttttctcatttccaccttttccctgttttacacgagggcacgaggatggggctgcagtatcagtgacgcacctgtcaccagcgggccacagagctttgtgttagcccctctcaagccctttagcttctggaaccgtttaaattcttaaaaattatacaggaccccaaagagcttttgtttatgtgagctttatctattgacatttaccatactaggaattaagaggacatttaaaattatttagctacataaaaataacaataacaaacttactacctgttaacacacattttaaaatgaaaagtggctacattttccaaaacaaaaaacgtgaatctttagctcaatcaatgtttcaaatggaagcattatgacagtcaaaagctggcaactaaacataactggcacaagctctgccaccgagacaatggaggcctgagtagtaggctccctgcagaatgaaaggactggagctgccagcatcaacaccaacgcatctcccaacaagggtgagtgaaaacacacacctaaagacctcagagagcacgtaagcacacagctgtgcatccactctgagggtgagccaccaagcacacggtgaccccggggagcgcccgaagggagtgaagtatctgaaggaaagaaggaagtgagcgatgggcaaaggagaacctgaggaccctggcacagtctcagctgcaaacatctagtcttgcttaactggggtgcagaggccactgcacctcagggttctcacgaagcgcctgacctctctattttattactattattattattattttttttttttgagaaggagtcttcctctgtcgcccaggctggagtgcagtggtgcaatctcggctcactgcaacctccacctcccgggttcaggcgattctcgtgcatcagcctcctgagtagatggaattacaggcatgtgccagcatacctggctaatttttgcatttttagtagagtcggggtttcattcaccatgttgcccaggctggtcttgaactcctggcctcaagtaatccgcccgcctcggcctcccaaagttctgggtttacaggcgtgagccaccgcgcctgagccctctaagagcccccgcctggcgtcgctgtaggcaaatcccaaagaacgtgtcccttcagcagccggctggggcgccacaaacactatctgttgtcttcgctttagtttgtgtcaaagtgactcaaagttacacaacactggcgggcgactgccgcctttttaccctgtggcctttcccatccaggcgtccagagggtgagcccctgccctccaggacccctcccttccaggaccctacccgtctgggactcaggccttccctgactcctccctcccggactcacccctcccagatccctcccctccgggaccctctcccctcccgggccccctcccctccgggaacccctcccctcccggactcacccctcccagatccctcccctccaggagcccctcccctctcgggacccctctcctcccggacccaccccttcctgacccctgccctcccggacccctgcgggactagatgtatacagctgagaccatatcacggttctcaccctcgctctaccctcccggacccctgctctcccggacgcgtggactccagctcccgcctgggtccccaaagcgctgaacccatggtcacttctatgcgtagccctggtgcccgccgcccacagccggaccgcactcctcggcctccgcctaacccctggctcagccacacgagtgacagctctgcccgcccgggcgggcgacgccgaggggtgggctcggccccacctgagcagttccccagcgcccctctgaaacccgcctgtggtccctggcgccgcctctaggggccgccgccgctcccctatgacacagcaacaataggggccgctctggtccaagcgccctgcggcccgcgcttccgccggaaaagagccgccggcgcgggggcggaccggggaggagcgagtgcgatggacggtcgccctcgccaatcgttggcaggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggtgcgggagtcgccgggcctggggcggccgggggcgaccggaggcgggggcaggggctgctggaccaaggatggggcgggggcagccaagacgagaaggtggccggcgcggcgggtggggcctgcgggggccgggccgggcgggggttctggggtctcgggcgccgccccggttccgcctgcggctctgaacgtggggctcggcgggagctcgggcgggtctgccccgcggagcgggtcgccggggtggcgcgtcgaggctggtgccccgcggagacggcgtcaagcctagggccggccccactaggcttggcggggctgccccggcccagcgccgagtgcgggcggtgcgatcgtcgtgagcggggcaaacgcggaaaggcagcccggcgtgtctgagtctgccttaggcagctctgggcgcaggccccctgctcgcaaacaccccagggggcgggagcttgccggaccgcaggcgacagtgaccgccgcgtctcagcgtcctctccgcgctttcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgtgagtgtccctgagccgcagcagcaggacaggcgacttctcgggccctcggagtcctcgctttggagttcgcggtgggggcttggccgcatctggggaccgctcgtggggccgtcatcgactgccctgctgatgggtcgtcctggtttccgcggtgacaggggcatctcggccactgtgtatcttgaactgtccgtgtgaggtgcctgggttggaggtgtggccctggagagcccggagctctgtgcctggccttgaactgtccgtgtgaggtgcctggggttggaggtgtggccctggagagcctggagctctgtgcctggcggcttcactcagtcttctttgtttttcaaactcttagttgttctttgttacatttgagagcagttcagcgttgactttttaactactctgggaatgttgtttccagcacgtctcagaaaccccgttgccatctgaaaggcccctttccctgctctctcccccggccttgcctttcatgggctgtctctgaccctggcttctctgccttgtggagaccctgccagcgaggggtctggcggcttagctgccccttgcgcaccccacccggttagacccagggctcagtacgctctcctgagactgggcacagtgatgccatctgcgccactgactctctcttcccctggcttgccaggacttgatcatcttccctgacgactgtgagttcaagcgggtgccgcagtgccccagcgggagggtctacgtgctgaagttcaaggcagggtccaagcggcttttcttctggatgcaggtatggggcaggccttggggttgtgcctttttgttgccctgcgattcggttaggaacttgcttacagtgtggtgcaattggcttttataaaccagcaggcgccggccacacccggccacacggcctgagatgccacctcagggctgcggtgcatgctacctggggccgaggtcctctcccagagtacggaggctccaggctgggctgcgggcaaccgattgcggtgtgaaatttccaggcagacagacatgctggccctggttctaacgatgcccagtgccctctctctgccccttgccgtgggtcactgaggcccccacagcagaggcagaggcccctgtgtggcttccctgctggtgctcacagaaacgaagcatcctgctcacactttccacagtcctgccccttccctggcagtgtgtcctggaggccaggggtgtcagtgcccagggtttctcttacccacagctgcagagcgtcttttgggtctagaggccgctgctcattctgccatctgtcagtgaccattgagcttgttgccgttttttgtgctgttacaggcagtgttgcaaagaatttcccggtacacagatcattttccataagccagtatcatctgtaggtgaaaactggtggcgggcctgtggtcaggaagcgtgtgcatgcgtttgcagtgtggagagagaaggccatgctctctgccagaggtggagctgctgtccccaccccaccccccttggcactttcaagagcaggggtggccctggctgaggtctctgtggagcacatggtctgtgttgctggtcacctgtgcaagtagtgtgcagcggcctgagaaaatgaacaggcatagccaaactccagttaaactttatttgcaaacacagatggcggccacaatttgccacctgctggtgtagaacgtgtttttccacggttttgccaagaaatagtgtccaactgttaccaccatctcccttttttccccgattttcctgttggtggcttttaagtcccccgtccctgctttgccatgagagcagggactcccagtgtccctggcgccctgcagcttccatagccattcggggtgtgcgtgggtgctctgctcccagctctgtgagctcgcaggtcgatgcttctgacactgatctgtgcacatgtgtgtgcacacgcgtgtgctcgattgtgagcgcctgccgtggccctgggccgcggtgtgctgagcgggccagttcgctgccttccactggttgaaggaaggagacgggtgtgtaaagaaccgcaccccagagggcaggagggtgagagggcttggtctggcagcagctaagtgccttcggagctctaggctccccatttgtgaaatgggcggagggggacagggcacacccgggattgcggcggatggggacagggcgcagagcatcgtgctcaggaggcgccactgccgtcccctcacctgctgggccgggtcctgtctcctcagcattgtgtggccaggcacacgcgcctctgcgtctcaggtccctcacctggaagccaggtcagaggatggctgtggtggccctgggtgagctggcgccagctcctgcccttacatgcccttcctcttgcaggaacccaagacagaccaggatgaggagcattgccggaaagtcaacgagtatctgaacaaccccccgatgcctggggcgctgggggccagcggaagcagcggccacgaactctctgcgctaggcggtaactgtcacatgtgtcacgtgagctcagggtttcctgggaggccagagtctactgtggatgactcgccccctcagcacaggttgtttggaagtggaaatagaagattctaaaagttagagaccctgtgagctccctgggtcactccccactcccaccttcacggggtaggacgggtctgcatcccaccgtcgcctcacttcaagtggtgccccctgtagggttcaggggcagccgagtgcggtgctcagcagaggcgcaggcagtgcggtggggcccgcgtggatctggctggggcaggcccgcctgagctgcagtgttttccaggtgagggtggcctgcagagcctgctgggaaacatgagccacagccagctcatgcagctcatcggaccagccggccttggaggactgggtaacgtgcgccacccgggctctcgggcagcttctgctgggaatgctttgaggcccggtctctgtttcctttaaacttctgctggctctgtctgcgtagtgtcggggagcctgtgtgtccgcaagctggttcccctttgggaatgcgcttgtttgcctgtggctagagctgggtaggcgagggcttctgggcccctggtgaggaccccagctgggtacttcagaggagggtggctggccgagcggtggggctggaggactggagggagctggggttcctgcgccctgggtcccctggccctacatggctgcctgcctgctgccagctcatggagtgcagacccgtgtgcttggcccttcagaaatgcttgtccctttgggtgggatctggactgaatcttctaatctaagcacatgaattgtgtaatgggatggaacagaaatgaccttgcttccagaacacagccgcaagtgtccacccgccccacgccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccaggtgagcctcatcgctcctgccacgcaggtgccacggtgttaagggaggggcagtggggaatcctggcccagcaccctggaccctgcgagtaggccctgccgtgtggggcgtgtccgctccagcggtgccctctctcttcgcagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaaggtaacgtgtgctgtcgcctggagctgggtggggggcatggggcctgctgaccctcgcacgctcaccttccaaggcatctgcctagtgtgcgcgcctggggtgctggggccatgggctgagtccctgcttgcatgccttccatgtgggcacttaggctgtcatcgagctgatggccgtgttcttgtgccccagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggtagaggccgggcccagggtgtcctccactgtgtgctcagggagtgggcaggggggaggaggaggccctgccccaccttcaccatggccagtgcttcatgtgcctgacccgcagagctggcagctgagcagtgtggctctggggtgcagcccgggttggagctcagccctcgcctggctcttcttgcaggccctgggcatgttcagcgcagccttggcctcggggcagctgggccccctcatgtgccagttcggtctgcctgcagaggctgtggaggccgccaacaagggcggtaagtggctgcgcctgcacctccaggccagagccaggggcagggtccattcctgtccccctggatctgcagaagtggggctgagggggtaaaggtcacagcccttctgcccttgatcccatcgctttgatccccagttctgggcaagggttagacaccaccttgtgtctttaacgtgttctagatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaatgcttagtttctttgcccaaagggagtttcggctggacaggtgctagcgtggggagctgctgtagggtcccagagacagttagttatttgacctaacaacggaaaacggtcaccccaggaagagtttggtgcctctgtccaggccggttccagatctgtcttgagactcactctctccgtatttaagtcaacattcattcggttacacagaagttactttttaatttttaaggaggaaccagtgatgattggtgacaaatctctcacaattaaaaatgggtggaagggccaaatataaaaacattttgcagtattttattctttcgtttaagaagctataacttaaaccatcttcagaaacaagatctgtcacccgtagagcttagagtccaaatagacacctatgaggcgagcacaaggggcggtgtgaggcagctgcaggggcctgaccaggggccggggttggctgtgtcctaggcggctgggcagccactggcccccactgccccgtggacctccacagagcgagtcatggcgacgggggaccggttcaccgccagcctcctcatgcagccgcagtaggcggggggccagggctgcacggccatgggctctgggggcacagggaagatggaagaaggctggttggtgggcagctagagacccacaggcccttcccaaacgtcagtgccccacccagcccctgtctcattccacatcataggagggtggtaggggggtgggaggagggtgggagggggcagggggtggaggggtggggggagggtggtaggttacgcagcacctagtcctgaggggcagctcccccacccttgatcaaggccgcactcaccaggcaggcccccgaggtacagaggggctggggcaccagctgcagccgccagcaaggggcccacggtgtggttgctctgcgcgtccacctccagccggagcacattcccgcttttcatcactgggagaaagggggactcctgaggccaggtggtcctcagcccagcctctctccagccccaaaagaagccaccccacccagagtcccgcctggctcccgctctgcagaagggtgggggtggcagagtgccctggccacaggaggggcctcacccgctagccggtgccactggccatcacacagcactgaggggcgggtcactgacgtggagaactcccctgctccgtcatccgcccgcagcaggacctggcggggtaggaagggagggtcaggctatgcccccgaggtcaccagaatggggaggcaaaccctgccctggcacgccacctctgccaggcttacttgcttctcggtcacctgcaactgcaagtaggggggcgtccgggcctggcccaagtggaagatcagtccggtgactgccaggggccgcacctccagttccaggcccacatcaggcagtgtagctcctgggaggtctgcggggaggggttgtgatggagaagaaagggggggcccctccccagaacctcctggagccccctgccctgccctgctgaggcctgggatgccagcacccacagacctaaagtgataactcccccgctgcctgggaagaacaggcccgcctccagggggcccaagatgcagggtgtgacccctgccatccgtgtgggggcccccaggggcctcccgtgcagcctcagtctcttcacacagccgctgaacccgacggtcacctataggagcagaccgggcagggatcagggcccagggcagctgaaagggaacagtgggtggggagtgggggctggggcaagatggttctcaccggaagtttggagctgtggctgctggccgggaggccgcccacaaagagggtgtggggctgggggtgctctgccccctggtgctgccggtgcggcccctcctggctccaggcccgggccccgtccgtcaccagcaggatccggttcttctcccagcgcacggagacctgggggcaggagatgggtcagggtagggctgccaggccctgcccaccaccttccttcttctcggccctcaccttgtgccagcggccaggccgggagcgctggcggctctgggcgcggagccgagtcccgaggccttccatctgtgcaacgaagtggccattgctcaggaagagcgccagggaggggctgccgggcctcagacgggcagtgaagaggaggaggcctcgggagcttcgcgggaggacgtgcatggagagactgggcctggaagcggagctggcgtcagcctgcgcggcccctctcagcccaccccagccgggcctggccttaccagttcctatgtcgggccaggatgcccacaaactccaggtgactggacagggaacccccaaactggtaggagtctcgggtggtcctgaggtgtgggggcagcatgcaggcaggatgccgggcgggctgacggctgcggcgggaggcctgggggcgtggatggtgaatgcaggggccgcccacacaggggccacccttccagccaccccagctctgcctgctcacccctggggtgcccaccttccgggcggtggcctgcagtcctctaggccccaggcccggggtctgggcttgcagggcgggtgcacagcccgtgctcacattgacgctgcccaggttctgctgcagatcaaatacgcgctgtgggcccaggagcctgtgcagggcgggcaggcggtcagcagctgcggaaggccagctgggaccttgtcccccagcgcccaccaggctcaccgctgcacgaagacgttgctgatgcagccactgaagttgtaaatggtgccagactcaggcaggcctcccaggaggagcctcgggggcccctcaggctgcggctggagctcggggggtggtccccggtggggcttcatctgctggagctggtcatcgacatacagccagactctggggggcgggaggccggaggctcggtttttccccaccctgcccacccccacctcagaggagacagaggtccaggcaagtgcaggcgggcgtccctccagaccttcacgatgagggcccagcggccaggctcaccccgtggcattgctgtagaaggcgacgtaatggggggcaccatcggcgaagcccgcttgagttttcacttcagtcctcaggagctgtaggctcacacggccctgctgcagggacacctggcatagcccatcctggggacggcagccaggtcagccggccggcctggggacccagactcattccagacaccccagtcccaactgctccgacggccaccgcggggtggggaatgggcacgggtgtgaggtctcaccggggacgcccggtagtagagcagggcactgtcctgggcgctgtggaagccgaagccggagtagacgttgccagtgagcggtgccacgttcgagagcgccaggcgaaggaagccgtggccatggaaagtcatggcgcgccccacctgcggggaggccatccctgagtgcccgcgggtgcccctgcatgtccacagatgccacccccagcccggggagggctgctcaccagcaggtcggcggtgcagccggcgctcacgcctgtcgtgttcagccgcttgaggtccacatacttgcccagggccttgatgcctttgacgcagccacggactgagcctccggtggggaagagccgtcgcaggctgtggggaagcggggatgcgggtcagggcgccacctccaagcccagcctaccgccccaacagcctggcctcggagccccagctgcgcacagtgcttacctcgggggcagctggtcgggcggcacgccccccaggtagtaggcgtcggccagctccagatcattgtcctgctccacgctgtacaccgtggcccgctccacacgcaccagcacacgcttgcggctgccccccagcaggaacacctggatctacaggaccagtgggggctccagggccagctgtgtccctgcggcctgccccgcccccatcgttccatctcctctccctgccaccctggtccccaccctggccctaccgccttgctggccgaggtcaggggcggtgggggctgcagtgggacggcctttttcaggccagccccaaagtcatacaacagcacgaggctgccttcttgcacggccaagcacaggaactggctctgcagaaacagggcagggttagtgtggggcagggtcagtgcaagtggggatggcaggacgggtgtgcctggcgcacctgctgcttcaggaagaagagcaccccgctgtaggacacgagccgcagctcctgctcgaagcgcttggtggtgctgatctgactgtcgaagctgatgcgggcgaagccggtgccgtccaggtaggagccgtccgtgagccacgggtccccggtcgacttggagctgcaggtcggagattctggggtcagcggagggtggggtggggtgggtggagacggggagggcaggccacacgcaccgggcacaaggcctgtccacagccgtgtccagctggaaggtcctctcgaagttgtagaggctgaccacctcctcattcagcgtgtccatctcgatgcagccccggtagccggggaagcgaagcaggggagggggctgtgggcacagggctgggtcagggcacctggcctgaggcgcctcccctccaggatggaccaaggggacttcagactacagcaggacggactgaggcaagataccaaaagaacccgcggctctccaggacacaagcgactcggggctgcggagcccctcccaggctgccccaggccgggcgggctcaccgtgaaggtactggggtaccccccgacgtagaagacgaagtcgtctggccgcaggttgagcagcccctctgccccaggggccaccgtgtcacccttggtttcctggatcatctgtctctccactgtgacggacatgtggccaaactggagagtcctgagggcagaggcgaggggtggcgagtgggcacggagagatgaggggtggcgagtgggcacggagagatgaggggtggcgagtgggcacggagagatgaggggtggcgagtgggcacggagagacgaggggtggcgagtgggcatggagagacgggtggcgagtgggcacagagacgggtggcgagtgggcacagagacgaggggtggcgagtgggcacggagagacgagggatggcgagtgggcacagacgaggggtggcgggtgggcacagagacgaggggtggcgagtgggcacagacgggtggcgagtgggcacagagacgaggggtggcgagtgggcacagagacgaggggtggcgagtgggcacggagaggcgaggggtggcgagtgggcatggagaggtgaagggtggtgggtgcacacggagaggggagagatggcgaacgggcaagggccctgcagttggaggcatccggcctctctcctgggcctcccacctgtccaggctgacagctgcgaactgctccccaatgtcctcatcgatgcttaggactgcagggcccgcctcacccagctgatacacccagtgcaccttcttgtcacgcagagacacacccatgtagtccccagtggcctgcggcagtgacagacacacagtcgggatggggaccggggaccagggaccaggcaccgctcatttccaaacagagcctgagctcgggccgcatccacccagccagcctggtacctggcggctgcccatgtacatcacaaagcgatcctcggtaccctgcccaggctcaggctctgggccctgcaggtagaacttgagggcagtgtaggcagcaaggtcggcaagatcccgtggggtgcgcagctgcacccctgagcgcccgttgaacttcatgggcaccttgacctgcggggcacggtccatcagcgtccaccaccaccctccctgatgtccaccttcccctgggactctcacccaccttactggcagccccccgggcctgggcaatgagctctcgcacgcggccaatgctggcggacagggccaggctggcgttgtgcaccccacggttctccaggatgctcagcttggccagcagctggggcagcgtcttctccagggtggacactgcagagagggagacctgagacctttgccccccaccgtgcccgcctccatcaggggcaccgcgagggccatgggcgcacctgagtggcctgcgtcaagcactgcctggcccaggtcctggccccgcaggccctcgtactggccctgccaccgctccacattctcctgcatggcctgcagctgggactgcacacgggtggcggtgtcctgggcttcagcagccacagccttggcatgtgcgatcttcttgcttgtctcgtctgtggtgggcagagggcaggctcagcaggggccagcggggaccatcctggcttcatgtccccaagtctttctgttgggccagcaacagggacatccaaccccctatggatcgtgtgagaccctcacaccccgctgctcagtgcaatccaaacccatcctaaatgcctccaccagacgccccctccatgccaggacaggcacccagcctctcaggccacagctggtccctggacatgtgccccatgtcacctcccaccacctggcccccaccatctctcctgggcttgctgggaacagtccgcagccacaggggtccctcagaaactgggtgaggcacatcgtcctctgctccaagcctctcagggtgggagccctggtcctcaccgcccaaggtcttgccagccccttggttccagccacgctgaccactgtgccctcctgggtgcccttcctgcagggtgtgccccaatcccccccaaggcctacagccctcccacctataactccatttctacccaaagcacttccaagcttgccaggctcccgacggctggggctgtctgtgctatctgcagccctggcacctccctggtaggctttctgtgtctggccccagctgcccactgtgggggtctcttccacagcacagtgagtgctcaccaaccacatgtggccagcgccactgtcacagagcctcatggtcggccggctgcgagagccgggcccaggctccgcatacctgtgtccatggcaagcatggcctgcgccgcctggatgtgcgcctccagctggtccttcttggcccggacatctcggagctgggtcctggcaccctggagggcagcccacactgcgggggaggcagcttcagctcccaggcagcttcacccccagtatacaattgcagcccacctccacccttctgaccccaggaggaccaaggctgacacacagcagacagatggacagggacactcagacatggagtcccttagcctgtggggaggtgttgagtctcagcgtagcctctgttccctgaaggcctctggtcccactgcaggcatagctgtccccattgtacagatgaaacaatagaggctcagaagagacagccctctggtcctagcagctcacacctttctcattgcgcagcttggcacgcgtgtagccctcgggtcagcagagcagaggccacgtatctcttgccctgtgccctgtggctcagctggtgcctcagtggcagccagtgcctcgcaggaggctgctcctccctggactcccctgcagggctccccggggctgacacacaagcagctggggagccatctccaaagctctcccaccccaaaccatgctgcggtgacccacaaaccccacgtgtgcatgtggctgggggctgagggtccctgggagctcagatgcccagcaggcctaagggcccccatcggagcccagcactcaccaaggcccagcctctgctgttcctggagcatggcctcttctagtgcagtgctgttggccaggagctgctgggctcggtccaccaggccctgccgcaccaccgtctgtggatgccagggcagaccgtggctcagacacgcaggccggggctgcgggaggtgcaggcagtgggggcgctcctgctggggctgaggggaagtgaggggcctcaccgcccacgtgtggtccgcctgctgcagggcctggccagcagcatcctcggcagcctgcacggcctgcaggatgcggctgtaggcgttggaggcctcgatggccctctgggtgaggcggtcctggttgacgtccaggatgatgctgcagcggaagggagggtcgaaggagtgggtaagcgcagacgccctcggcctggctctccagcctcctgcgctcacaaccagccgtgcccgtgcctgcccgccaagtcccgcctccaggtctttgcccgtgcctgtcgcctgctgggtgtactgctcctgtcactctgggccccagcttgccgtggagctgaggaaggcctggcttctttgaggacaacggcctcagcccctaggagccttcccagaccagctggccctcccaaggccctgtctgcatccccagggtgggcccagggcccctcctctcctggccacccacctggacagattgagtgccagctggcccagctgctgtgcgtgggcctcggcggcctccactagacgcagcttgctgcccgccggggagaaggtctgcatcctctgcagcagtggggtccgagccccatccaggctggcggcgaggcgctccagctcctggaatttgagtggacttagcccctcatcctgctcacagccacctgatccacgaccctgagggcgggctctgcacgcaagtgtgcacacaaagctgcccacgggcctgggagggagttggccgtggatggggtggcgacaggggccaggggctgcactcacctccttagcctggtccaggctgtgcagcaatctgaagacgctggccagggtgtccctagccgcatgcagagtggcctgcagggtggcattgtcccgggacagctcctgcttcctttgctgaaggcaatgcaggggagttggggacaatgaggggtaagaaaagaataaaggatgtgatggggtggacagcagggcagggaagggagaagaaaagagggggagtatggggggtgaggaggggggaggaggggagggttagaacgtgtgagtatgagggaaggaggaggatggaggggtagagagaaaagtggggaagaagagaaaggaaggcggaagggggcaaaagggggaggggacagggagggggagaagaggaggaaaggatgggagggggtgaggagagatggggaaatgagaggaggagaaggggaaggagagaatagaggaggtggggaaagggatgaggattggggagggacaaggagggggagggggatgatgggcagatggggagtggggagggagaggacaggagaagaggacaggagaagagggaggagagaggagaaggggagagggggaggaggaagaggaggagggggaggggagtacgaggggaggggaggaagaggaggagggggggaagaagaggaggagggggggaggacgagggaggggaggacggagggaggggaggacgaggggaggggaggggaggagccggagaggagagggattgcagggaggaggcgggaagaggagcaggaggaagaacaagtccggggtcctcaccagggcttcctccaggcgctcctggttgcggctgttgagctcctgggcctcccgtgtggcgtccactgcccggttcaaagcctctcgcaggtccatgaggccggcctcgtgctgggccagccggtcgcgggtttgtgtggccagtgcctggttctcctcccagaggctgctcagctgctcctgcacccgggccagcactagccgagaccagggtgagggtggtcactctggaagccaggccccttcatgacccctggtctccacttggtgcccgccagatccatctgccccgtgatgcccacctgatgccactccatgctgacctcccccttggagctcccaggtccctgcctctccccaccccgcctgccagggacaacaccactcacatctctgtgctgcagccaactcagcctcagctgctgcctgcggggcccccaggtcccgggcccgcatctcccagagcagccgctccacctcggccagtgtccggagcagctgctcacctgatggagccgaggcattggccagccccaggtggcccgtctgggacatgagctctgtggggcaggggttcgtcagagcctggggccgcccgtactagtgcacctctgcctgctggcttccaagcccaagaccccagccctgccatccttggcaggccaggggcccggaacctgagcgcacctgggtggcccctagagcacctggcgaaaggccacagctgcctcacctgcccggccctcacctcctgcagtgcctccaacaccctgacaccagtctgctcagccagcttctgagccttctcgtcctgcccctctccgcctggcccaccctgctccctggccagctctctctgacatggcaccccctgccgacccccaggctgggctggcaggtcctgttaggcaggctcagggagccaaatctctcctgagtcccatgtctcagtgtgcactacgggatatctgtgagcgcgaacatctaaccggcacatttcctggggaggctgtcgaggggtctgacgtctcccggggccacctgtctggccacacggctgtgtcgccgacctcctgaccctgccctactgttcactccagaggcgtcgtctcccatctaaaagacagatcctgcctgttcttccaggccaagctcggccaggcacccccacccctaccccaggcagccctcctggctctgagccctgagcctggctgggctggcccctaccgctcagggtgcggtccacagcccggatggccgccaacagcgtcttcgcatggcccagtgtggcctcggtgccggccagcaattggctcgcctggtctcgggtccccacggcctgtggaggaagagcccactagcccacgctgctggtaggcgagggtcggggtggcaagggagggcctggggtctgggggagcgccgagggtcccagggaagaggggccccttatctatttaactctcttatctgatgacttgttatttatcacttgttagttacctaaaattattggttataacttgccatttgttatttcctgtcaatttaatgaaatagttactcattaagacatttgaggccggccacagtggctcacgtctgtaatcccagcactttgggaggctgagatgggcagatcacctgaggtcaggagttcaagaccagcctgaccaacatggagaaaccccatctgtactaaaaatacaaaattagctgggcgtggtggcgtgtgcctgtaatcccagctactcaggaggctgaggcaggagaatcgcttgaacccgggaggcagaggttatggtaagccgagatcgagccattgcactccagcctgggcaacaagagcaaaactgtgtctcaaaaaaaaaaaaaaaaaaaaaaaaagacatttgagtgatattatacactgtaaacaaatgtattaggtagtttagatagtaattcagtgacttggtcaacccctaagactctcgagctcctgtcccctgcactgacacatgtacgaggcatgaagtaacatctgctgaatgaggacaagcgaaccgcggggaacacaggtgaaagcctcccggggccctggggggtcttggggctcctgcctggccgcctagccgccgtgcgtcctgcccgaggcttgtgctctgctgctccagcacctccagctgctgtgccgtctcatggcgggggcccagggggctccggagctggctctgtgggaggcgaaaggtgaaggcctgcactggcccgggttggggagggaaggccaggacgctcagtacctgcaggtcagcgatggaggcgttcagcctgtgcagacgggcccaggccatggagctggcattgatgccacgcagttgctcgtgaatggcggggaggagggcgccggcccgttccaggtcatccaggagcaggaccacacagtggtcacacactgcaggcgatgtggggtcacaggtcagtgtcattgggtcaggccaggggagaatgatcagctggggccctggggtcattagggtggggagggctcagccagaggtcatgaggtcagcttagggacacaggacctgtggggaggtcccagagttctggcagagtcatagggtcaggtaggagtcagatgggagtgaagggcatggggtcacccagggagaaggtagggccagcacaaggggttggggccggaggtggggccagtgaaggggcggggccggtggaggcagggtcagtgaaggggtggggccagtggaggaagagggggccagtggaggaggcggggcctgtggaggggtggggccagtggaggcagggtcagtgaaggggtggggccggtggaggaagagggggccagtgaaggtgtggggccagtggaggaggtgcagccagtggaagaggtggggccagtgggggtggggtcagtggaggggtggggtcagaggacgggtgggttcagaggacgggtagggtcagtggaggggtagggccagcagaggggtagggccagcagaggggtggggtcagtggaggggtggggtcagtggaggggtggggtcagtggaggcagggtcagtgaaagggtggcgccagtggaggaagagggggccagtggaggcagggcctgtggaggggtggggccagtggaggtggggtcagtgaaggggtggggccagcggaggaggtgcagccagtggaagaggtggggccaatgggggtggggtcagtggaggggtggggtcagtgggggaggcagggccagcagaggggtggggtcagtggaggggtggggccagtggaggggtggggtcagtgggggaggaagggccagcagatggggtggggccagggcacacaggaaggctagggacagtagaggggtgcagccagcagtggagctgcagcgctcctcagcgtggttggagttggacaggcatgggtctctcgggaaatggaaggcagctgggaccactctgggaggtcgacgttaacactggggtcaccaggctgtgtgggacttggattcctactccatcaggtgtggggaagtggggtgttgaggacacaccttcacagtggatgctgtggcccacaggcccgcctggaacaggcacctgatgctgctggctgcaggtgtcgcagcgctccccgctgagccccggggggcagttgcagcggcccgtgtgagggtcacagcggcccccagggcactggcagcctgtggtggggggcttgggtgagcatggctggcctgggaccttggagcgtaccccactcagaagtccccatccgccctcctgtgaccggccagcactcacgcctgcagccctgctcagggagcccccagtagccaggggcacactcgcggcactggggtcccatggtccctggtcggcagtggcactgtccgctctgggggtggcactcggagccctcggcggccggtccacaagcacacgggcggcagcccccgcagccatcgaaaccaaaatgtccctcctgtggcacaggctggtcactgccctgcccagccctcaagactgtcccagaccaacctggaagccaggggtcctgcccatctggccccaccccctgaggctctgcccatcaaacactgcccctcagccccacctatcagattctccccaggccccaactctagtccctaggccccacccacccagccctgcttaccccacagccctacctggcagcggtcacagcgccgcccagtcacgcccgccttgcacaggcagtgcccgctgtgggggtcgcaggcctctgtcccacatggggtacagtcgcaccctgcagaaggggtccgtgactgcagccctgggccctctcacccccccagggagcccctaggcaccctcctaagccctcacttcactgcctcctgctgtgtctcctccaggccgcccggaccacccggctacccactcgtgtcccagcctggccccactccccagctgcctcccctgggcccgagggacctgcagactccctgccatggcctgccctgctctgacggctggtgtccgctgccagtggtggggcattggtggtggtgtctaaccatgaggggggactgattgtggggggagaggggatgtgatcgtgaggtggggggggcgctggtcatgggttggggggagggtctgatggtgaaggtgggggcctgatcatgggtaggggaggggggatgtgatcctggtatggggagggtctgattgtagtagggagaaagggtgtgatggtccgggggaggcctgatggtgaaggggcctgatcgctggggcgggagggcctgatcgctggggcgggaggaccggatcatagcgggggagaaagggttgaccatgaacccagaaggctggctccgacttgtcctggctgggccccagcatcaggcacacagcctacttacggggtacgcccagcaggcctccctcctccccgcgcaaccctccccagggtgcatccctcccagcccgacgcctacgggtgcagttgccgggcagcagggcgttgccgtagaagccgggggcacagatctcgcagcggggcccagtggtgtggcgcaggcagccacggcaggcgcccgtcagggggtcgcagtcgctgaagagcaagttggggtcaccgttgccgctgcagtcgcatggctggcaggagctgcccagcaccagtgggttcccaaagaatccgggcgcacacctgggagcagggtggggaggggccgtcagtggcccgtggcgcccaccctcgcatatcctggggtcagcactcaggccctgccccactgccctagccccagctcaccgctcgcaggaggcacctgcataaccaggtttgcagaggcactgggtgcggccgcctcgcaggacacagccctcggcgaagctgcaaagaccagcagcgtcagtcactaggcccctggcagtgcccgggcccgggcgagcacactgtgctccggctggaacacacgccaggcgtcgggggcccagacctcacggacacctccagctgtccaggcctctgcagagggcagtgggaacccaccccgctgctgggtgaagggagcctggcaccatcagggcctcgtcccgggaggaggctggcttacttgttggaaggcactgagagggggcaggggcagctgacacagggggcgctggggtcgtccctgctgctcacgaagccagcctggcagcgctcacagtgggccccttcggtgttgtgctggcagtcctggggcagagtggacagtcagagctatggtggacacccacatcctactgccgagtctgtgcagctcccaccacccctgcctcagactctgtgcccaaggccagatggtcccccactgggcaacacccttccccagacctcagttgacctggaagtgcagcccctggtcttccctggcacacttgactgtgccttcagtgaatgctgcccccctggccccaccagcccctactcaccacacagacgccagagccagggaggcagcggtctgagtgtccatggcactgacaagggacacatcggcccaggaagagacctttgacgtcccgatagaagccgggggcacattcctgagggtgtacgggggcaggtggcatcagcgattgagaggacgaggggccccaccctgcaagctcacaagtcagaccctcagggatcctgcaggcacgaggcactgggaacccgtggagcatggtcaccgctgggtcagaggctggtcaggaactcctggcctcggccggctggaggtgggccagcacctggctgctgtttgaggacatagctctcaaagccacacggatgtcctgtctcgggaatgaccaggccttggggctggtgaccacccactccatgtggaccagggcctactctttccactccttctaggaggtattcaaccacaaacctcctcatacagaaggagcaaagttacagcagacagacagattagcagggcagattagcagctggacagacacacagtgggcgagggatgggcagaatgacaggcagacgccaggatggtcggtgggggatgtccaggtgacccagtggtgggggctggggtaggtgggaaaggggtatggagggtgtgtgcatggaggggcaggcggatgaggggcaggcaggcggacgaggggcaggcagacaggcagcaggggacaggcaggcccatgagttggccagcagcctgtgaaaagcaggggcaggaagagaggtgagtagggtgacaggaagtggaggcagcaaggaagggaacacagggaggatgctggagggaagggtgtgcacaggtgagccgcctcgcagtctggtgctgtcctaacctcacctggcatgagtccccccggtagctggcggggcacaggcacagctccacattgctggccagggccccctggcctgctgggctggccacctccagtgccaccctgcgcaggaagacagccgaggagatctgtgagaagagggcacggatctgcagctgctccaggctggccagcaccatcatgagctcctcgcgggacacagtgttgcgcgtctccgtatgccggaagttcccctgtgggtccaggatggcacctcagtggggccacactcaatgggacagaacagggagcctagaacagaccccccaaccctgtaggggatggaggggcacaaagaccatggggcaggaggaggtacacacaggtagaaaaaccagtctcccatgaggccagccagcacctagatccctgcctcacaccacacatcaaaccagctccagatgccttaagaattgaaatacacaaagagaacagccaagcttctagaagaaaacataggcaggtcctttctgatcaagtagtgacaaatactttcttaaacaagatgcaaaaacgcttgctgccaaggaaaaaaggataaattcaagtacattaactataaggccgttcatcagaagacagctcaggctgggtgtggtggctcatgcctgtaatcccagcactttgggaggctgaggtgggaggatcacctgaagtcaggagttcgagaccagcctggccaacacggcgaaaccccatctctactgaaaatacacaattatcagggtgtggtggcgggtgcctatagtcccagctacttgggaagctgagacagaagaatcgcttgatcctgggaggcagaggctgcagtaagccgagattgcaccactgcaccccagcctgggcgacagagcaagactgtctcaaaaaacaaacaaacaaaaaaaaaaaaacaaagaaaaaccagatgagctgtgagaggggagaagacggttgttactctgaagtctgacagagggtaagcaccaagaataacaaagaactctaaaaggatggaaaaagatttgcaagtcaaagagaaatgggcaaaagatgctaacaggcagtgcatggaggaagccaacagctactgagcagctgctcacccctcagggatcagggactcacaaagcaggtgggaagacagcatgacaccccccagggtgaccagcacagaagatatctgacaatgggtgtggggacctccccagcccccaccccgcttctgctcctgggctgttttccaccacggagaatgggcacagcagcactgggaccccttccggccttcccagatgagctgaggtccatgagggacctgggtgcccaagccagctcccctcacctccaccagctgcagctgcccacggtgaacgtggccaggcgtggggtatgccggctccaggaatgtgatgctcatctggttgccctgggaaggcacatggggaggtgagggttggcacgggcctggaccacggtgccactgcgccacgcccacccaaccaccctgccacatcatctcagctccctcacctgcagcaccacatccggcctgctctccatggggacaaagacatctccccgctgggtctctgagtgcagttcataacggagggtcccaccgtaggatgacacctggaggcaggacagacagaggtgacctggccagactctggccacaggctcagagcccgtcagcagtggtctgggcacccccagcacagagccctgtgctgggcctggatacttgcgctcattccctaccgggacagggcctgggcaccctcacggacccccatggagctccccctccctggacagaccccgctcctggctcccaaccctctcaggcgtcctggccatcctcaaagtgcctcccccagacctgatgccctgcttacccggtcccccaggtaggagggtggggcctgccagtacagctcggggaaagcctcgggcacagcctcaggcacgtgccgcaggtctgcacggagcatctccgtccctggctgccgctcgtggggcaccacctgccggtcagtgctcagcagcacccatccctccatatccacgaactgtgggcacacacgtgtggctgcacacgggtggatgcccacacatcacagggccccatcttgcatccagtcccacctaagacctccccgagaaggcaatgccctcagtcctgcaggcgcacctcctggcgggtgtaggacgagctccggcagcgctccgtggccccaaagcagaagcagcgggtgcaacctttggggttggcagcatccagtgagaaggtcccaaggctgcactggtcacatttggggccctgcacgttctcctagggatgagaggacagtgagagtggtcggcaggtgccaggtgcctgaccccgggttcctggtacccacctgccaatggggatgactctcccaaaagcttctaggaagccccagctgccccgaaaggcccgtaaggacactttcagctgatgaggccggagggagaggccagatctgggcccagccctcactcaccttacagtagcactgccctgtgagggggtcacacacgccaggcgcagtgcccgcctcgtgacagtcacaggggcggcagcgggggtagccatggaagcccggagagcaggtatcacagcggcgcccagtcacgttgggtctgcacctgtggcaggggcgggagctgagccccctccaccccaggtcactcacaccaaagtgagacctcgtaggcaccccccacccaggcagcatcctcccagaagtggaggagagggcgctgctgcacccagggagcacaaatgggagcagggtgggtgccaggaccctctggctagaggaaatgctgtccttaaggccaccaggggccgcgctgacgccgctctgggctctcacttgcactggccgctgtctgtgtcacaggtagggtctgtgagctcctggatgccgggccctgagcagttacactcctcacagccgaccagggggtggcagccaaaggtctggggctggcacagcaggcagtcgggcgggatggtgcgtggcgggcagatgcactggcccgtgagctcgtcacagaggcgggcaccgcagtcacaggctgtggggcgggtacagggtttactgacccctcttcccagtcccgcccctctcagaggcccagaatgcagccctaggggatgtggcagtgtgacgggggcgggggagacaagaacagggacccctgccccgggtgctgagccttggacagctcctgacatggaggcagctgctcagaatcaacatcatcgtcagagactgtggaccacctgctggtccctgaaaccttctgcatggcccgcaagctggagtcctgggcccaggcccgcagatggggcagcaatgctgccctgccaggctctagaacattctcctgaccctgctttctggtcgacccgtccaccttgggctctggcaccaactccctgccactgggcgcccaaggactggggtactcacgcctgcagttggggaagccccagtatccggtggcacagcgggagcagtcacggccaatgacatgggcatggcagggacactggcccccgaagggctcacacgtggggcctgtagcacctacttcgtggcagccacatggacgggctccgttgttatagaagagggagagggaagcagcagcgtttcggcagaacagggatgagctgctggggctacatggaggggcacgtggtgaggccagctcccggcccagacccccaccccggacccctgacctgccagagccctgcccacctgatgtggtagccctgggctgcgcagtggctgatgaagtcataggatttatccaggggctcctcccggaggtagccaaagctgtagacgttctcagggaccacgagtacataatcctagggggtgaggcctggtcactctcccgcgggcccagagcctgcagcggggaggcccccagaggctggctgggaccagggtcctgcaggcagctcagagtcctggcagcagcagcccagcccagcccagcccagccctgggccctggctgctcaggggaggccactccaagccaaacagcagctttcgggggcatgaggaggcagcagcattcatgagacctcctggtgtctcccacatctctgtctgctggccacgccttcctcttccctctccttcctggaggccccacctcctccaggaaggccaccctgaccagcagggtgcagggtgcagggtccagggcccctctggagcctcacaaggtggatcgggaggtccccaaaggcaggagctgctttgctgggcacaaggccaggcctcagcaggcccagaagagacagacccagcccaagtgtaccacagtggtaatgacaagtataaggacagctggtccctgagcaggacatcagctgggactcaccagccagagccaccggcccttgggcacacgcacggtcacagtgagctcgctgtgggtcacgtccagcagggcctggccctcacacaccaccagggtgcggcagccgtagccatgtggacagaagctggcgttggcgtggcctgggcgggggagaaaggcagggtcaggcccccatctctagcgcccccaagacacccagagggttgaagatggcagcgttggggcagccaaggagtgcccgctggccaacggccacaggcacgggacgtgcccaagaggtctgcaaggccggcccctcatgtcacgggggttggccgcatcatgacctacagatgtcatgcgggacacctctaggtaccggtcaactccatgtgcgggaccccaggcttggccgagccaggaaccagacaaacacacagggccacatgtgctgccagcggcatcctggggcaagccctcaattcgccacgtgccatggagcacaacggggcttcccaacgcacgagacagaggcgagacccaggcttttctgggaacgggagcgggcgggtaggggctgcgggctgcaagggcagctagtttgagaactgatggcaggacagagtcatgttgcctgtcgctcatagcaggtagcacaggccacgctgtggcgccggcattccagcctcatcgtgtgtggtagcctctccaccccccacaccagacactcaccctgccacacgcggccggcgttgatgaggacttccacggggaaggtggggtgggctggctggtagccgtgcagcaggaaggcatagcggcccagcgtgggcacatgggtggtgaagaccacggtggcctgcagggataggccctagtgagcaggctgagctatgagcccctgctgccccctggacaacctgccctgggttgggacccggagtcctgccctgacacccccgtccctctagagactatggccctcacctggggctcacgcagcagggtgggctctgcatcagggtccacagcggtggggggccgaggtcggggtccagctggggacatggctggagtgagatcctgcgcgtgggtcagcgggaggccgggcggcagcgggatcacctggcagtccctgaggatgatgggctggggcggctttgggaagcgcgagggcagacaggcggcactggtgagagcacagtgggtgagtcagagccggccctgccgccgggccctcggccgcgcccctcccagccccattacctgccattacctgttggggccaaaggcgccgtggctgctgatgcagctgacccggggctccacgaactccgggctgaactcctcaatgggcaccagagtgaccccgtgctgcaggcagagggacgagatgctgcaacgcccgtggtgcggggaggatagggggtgcaggcggtacgatgggggggtgcaggcggtacgatgggggggtgcaggcggtacgatggggagtgcaggcggtacgatggggggggtgcaggcggtacgatgggggggtgtaggcggtacgatggggggtgcaggcggtacgatgggggggccggtcacacagctcagacccaggaaactgcaaacccaggcgtccgaccgagccctgctctttccaagatgcccttgctcctcctccagctgcacaaaccccaaccgcagaccagcgtgttggccagttcctgggcccacaggcctatgcggctcctcccatagccctcttcctccccctcgccctcccatccgtcactgttcccccactcttatctcgagtgctgcttggtgccaccaggccgggccaggcccagctctcccaggacctgacccaggcaggcactcagcaggcacaagccgcaaatgggtgctccctttccgtgcggccatgtgaggttggtgtctcggaacacggcaacttatccgctgacacaacggtgggagacgcggctgcacagaacatgttgtgtggcatttatagaaagtgccaggccaggtatggtggctcctgtctgtaatcccagcattttgggaggcccaagagggcggatcacctgaggtcaggagtttgagaatagcctggccaatatggtgaaaccctgtctctcctaaaaatacgaaaattagccaggcgtggtggtgagtgcctatagtctcaggtacttgggagactgaggcacgagaatcgcttgaacccaggaggtggaggttgcagtgagccaagatcttgccattgcgctccagcctgggcgacagagtgagactccatttcaaaaaaaaaaaaaaagaaaagaaagttccagaacaggcaaccaacgctgtctgtgccaggaggtggctgccctggggccagggagctgtgactgcaggtgctttcctgagcacatggaacagctcgggggtacgtcaaaagggactgaatccacaaaacgcttgcaggaggggttccagaagaaacatgctgggctgggcatgagcgagtgtggccgccttggggacctgggaccccaactgtcctctcccctctcatgcatgtttcaaatcttctgaaagaagctgaccccttggggtggggacctgaggggtccttaccaggaagaagcgtgcctgttcggctgtgagcctcacgctggcctccgagtccaggtggaagacagccaggtggtcctgggtatcccgggcagtgccccggcacagggtgctgtggggggagggtggtcagcaggtggggcagccccgggcgtgcccttactccagccccaccggctcccactcacctgtacaggcaggggtgcagggagagcagcccctgctggggggcccgctgtggggtgtgcacggccacgcccacctcctggcgggcatcctcattggcgtactccaccactagggcatagcggcctggctgtggcactgccacttgaagctggacgtccacctgcagggaaggcagggtgacgggaggcccgccacccctcgcccttcccacctccctcccctcccactccagcgcctccctgaccccagggcctgcccttcagccgagtcccaccctggcccggacatctccaggcaagtggtgggggctgagctgtatgtggaggccacagccaatcctacatacagacaggcactgaggtcacacatgcaggaggcaggaggcaggaggcaggggcgccctgcctgggtgctgggctccattgcctgaggcagcgccctgctcctataacctgccaccgccacaggacccccagcccccaggccaaggtcctgcaacacccattgctccgtggggtcccaggacacgcacatcactgcccgtgcaggtgatcagtggcgggtgcgacgggctgagctgctccgtggggcagggccggggcaggctgttgtcctggcgacacagggcctccagcccggcggccgaggggaagccatccagggggaggtgtgtgtagaggaggcagctggggggacacaggccgtggtcagccccaggtccacccaggtccccagagacagcctgagtgggggaagccaggcacagtgggggtccaggaagcccccaccccggtcccaccgcacgcatggccctcacttgtcgccagactgctgggcagagggacggtatgtgcaggcctcagtcacccgcagctgcaggagcgccgcctcgtagtatgcgctaggcagcagaaccacgtagtcctgcagggtggaggtggtgctgagagtggtgggccccaccccctgacccggcccccagccctcactctggcccctgcctcaccaggagcaccccttcggcctccacacgcagggcccaggtgccagggttcagcacaaagggctctccgaagcccctctggggcacggtgatgaaggcaggctccgtgctgggtgggaaggccacgggctgactctgtgctgtgcctgggcgggggcaggggtgagactcctgagcccagcccttggggccaccccaggctgcaccccctacagggttggggataggctggtcctaccacccacatgagccagaggaaggtggcggggcttgggagtggggtggggtggggtgggctgggctggtggggcaggggctgtggcccagggaccccactcacagttggcgcaggtggccgacctgccctcctctcgcacagagacccgcccgctcacactcatggccccccggttgacgtatcggaagacgagccagaaaaggtcaggggaggtcaggttcagcctggccacgatcctgggctgggtgggcatggagcgtcgggtcactctccctgaccactgccagcctgaggcctgggccttcaaggggcctgcccacccctccctgccagccacgcctggctccacttctaggctgagcctgggagggggagcacagcgcccacctggacaggtgccatctgcgcgtagcccctccagctgaagttctcgaactcgagggggttgaagccaaagcgcacggcgtgaccctcaggtgtggcagcctcctccagctccaggcgcaggtggtgcaggtccgggaggtagtggtccctcgcaggcctggccacagcaggggctggtcaggtgcagcttggccatcctacctagccctgcacagcggccccgggtctccagggagggtgaggcctcacgtgggcccatggtgagggacacggagaggcccggaggacaagctgcctgccccgctccccaccacccagtggggaaggggtacccactcgctgcaggtggggccctgggtgttggggcggcaccggcagacgcccgtcctcggttcacagctctggcccagtgcaccgccaatgtcacaccggcagcctgcagggagaaggtgggaggtcagaggctgcctggcccccacccagcctcaggggcccctcacagccagactgagaagcctgcctggggctctctggatgatggagagtcagggctcagggctcagggctcagggcgagggcgagggcgagggtgagggcgctgggatctgttagtgccgtctgcccaggtgtaggacaggggagaggaagccacgcatctgggtgggagctgcaccccctctcccacaccctggcacaggctggcaccaaggggcagccatccatcacccgggcttcatgctgcccaggctgcacttgtccctccgggccttgggttccccagcataaaccgaggggaggcagggctgtggtctgggacgagcgagtgggcactcactgcggcagccaaaatagtcagcctgatccagtccaaagaagccatccttgcaggacgcgcaggcctggccgcacacgtggggcttgcagaagcactggccggtgccctgggggccaagggaggaggtgaagtggggcaggggagggtcctgaccagtgtgcccccaaatcccccacaccttggtcctcagactcaccggctggcactcagcaactccacccagtgtgcccctgaggtcgcagctgcagcctggggagagcagggcaggactcagatgcttggtggggcaggagagcctggctccagccccccgaggaacccccacaccctaacaccccctccagggcacactcacaggctccagcacccccaggagcccctgcaccctgacactccctctaggatacacttgcaggtacagttccccaaggaacccctataccccaacactccctccagagcacactataggctccagccccccaaggaaatcccataccccaatactccctctagagcacactcagactccagcccccccccaggaacccctgtaccccaacactccctccaggacaccctcatgggtacaatcccctgaggaactccacaccccaacattccctccagggcacactcacgggtgcagcccctccgaggaacccccacacactaacaccccctccagagcacactcacaggctccagcaccccgaggaaaccccgtaccccaacactctctccagggcacactcatggactccagtcccacgcaggaaccccctgcaccccaacattccctccaggacaccctcatggactccagtacccccccaggaacccctgcaccccaacattccctccaggacacactcatgggtgcaatcccgaggaaccccacaccccaacactccctccaggacacactcatgggtgccatcccctgaggaaccccacaccccaacactccctccagggcacactcacaggtgcagcccctccgaggaacccctataccccaatactccctttagggcacactcacaggctctagccccccaaggaaccctcatacccccaatactccctcagggcacactcgcagcccccctgaggaaccccgcaccccaacattcccttcagggcacactcatgggtacaatccccgaggaaccccatatcccaccactccctccagggcacactcactggctccagcccctccaggaaccctgcaccccaacactccctccaggatatacttgtgggcacagttccccaaggaacccctgtaccccaatactccagggcacactcacgggtacagccctcggggttgctggggctcagtccccagaacccaggtttgcagcggtcacagctcggcccctccacgtgagcccggcacatacagggaacctgtgcctgggagaggacaagactgcaggtcagagcgggcgccctgctctcccacccacaaaccatagagccatagagccctgacaaggggtggtgagggctgagggccctcacctgtgactcacaggagtcacctgcagtgggggcagaggaccagcctaaggagcagacaggccctggggttgccatggcaactgagcagcaggcaggaagccctggtctcaccggactcgggacttttagcttggcctgggtcctcacccatctcccacacacgagcagacttgggctcacctcaggaagggcaggatccactggggccagaccggcagggtggcaagagccagctgtgaagagaggaccatgcctcggtcatttcccagtgaccaacccggaaggccaagggtgtcccaggcccagccagaacccacggtcccacaggagctgaggaccagcacaggtgcctctcatccacatggacggcctgaaaacacgcacctccctgctccctccgcagcaacggacgtgccatcccaccacacagcacctgctcatggacatgcacgcaaacgtgcaccgcgtggggtacccgtgtacattccacacgcagtgtgtgacacacgtctgaacaagcacacaaacgcacgtgaagatgcacccactacacgtgcactaacacacccacacgcccgtgaaaggacatgaacacgcacacccacacttgagacacgcgatacgcgcacccacttatgcgatacgcgcacccacttatgcgacacgcgcccacatgcgacacgcaacacatgcacccacgtgacacacaaacccacttacgtgacacaggcacccacacttaggtgacacacacacccacacaagcaacacatgacacccgtacacacacagaacgcaacacatgcacccatacgagacacgacaggcgcggatgcacagcacgcagacacgggcagtacgcggacacccctgcacggcatgtgaacaaggtgcgaacacagagcgtggggacgcagtcgcagtacacacagcaagatgcacgtgaacagcctcacaggaaggcaggcagcgtgtgaacagcacagacccacacacaggcccggcacctggtgcacacagccacctgcctgctcaccttcgcagtaggggaagttgtaggcaccgggcacacatgtgtcacaccgcagccccgtcacacggggccggcagctgcactgcccactccgggggtcacaggctgcgtgcagggagccttcagcagagcagtggcaggctgcagacaaggatagctgtgggcacgcagtggagactgcacctgcctccccaccacttcctccctaggcactcacggacacagctggggaagccgtgaaagccggggctgcattcctggcaggcagtgcctgtgtagccggggcggcagcggcacaaacctcccgccccacagagctggtccagggctccccgagggtcgcaggtgcatgctgcagagggacaatggggtcaggccctggcgccatgtgggtggcagaaccccttcctgccctgaccctctgctcaccttggcagttggggaaaccatggtagccagggcggcaccggtcacaatgaggtccagcaaactcaggctggcataggcagcggccggcctcatcgcagccctcgggcaaggttcctgcagggctgcagccacacactgcagagcggagcgggtgtcacggtaggccaggcccacgggcctcccctacccacgcccacgtggagaggcaccactcacactggcagagagggaagtgaaagtagccgggggcacagcgatcacatgtggccccctcgaagcccactcggcacctgcactggcctgtgtcagggtcacagcggtcatcggccactccagggctggaacactggcaggctgcaggaaagggtggcccacatgcttggtcagaggcaccaggcctcaggtgtccacctcgagcgcaggtagaggttgagcggggagaggggactcacgctggcagccggggccgtagaaccctggcgcgcagagctcacaatgggtgccttggaagttgggtttgcacagacagcgtcccacccttgggtccttccggcaggcgttgccctgggtccctgccgcgctgcagtcacaatctggagggtggggacaggcaggggagtctcagatgccctgcagaccccagtacgcccctcctggcaaaccttccctctccacaaactcattttcttacacttttacacaacactaactagaaaataaaataataaaaatcccagcaagggctgggtgcagtggctcacgcctgtaatcccagcactttgggaggccgaggcgggcagatcatgaggtcaagagttcgagaccagcctgaccaacatagtgaagccctgtctgtactaaaaatacaaaaattagctgggcgtagtggtgcacccctgtaatcccagctacttgggaggctggggcaggagaatcgcttgatcctgggaggcggaggttgcaatgagccgagatcgcaccactgcactccagcctgggcgacagggtgagactccgtctcaaaaaaaaaaaaaaattccaacaagggagaggcgtgtttgggaaaacagtgatgtgcaacaaagtcaggccaactatcaaaacgcttcattagttatttcttacgtagattcctagttagctgcaagcattaacacaaagagaaaatacaaacaaatcaaaactcaaaacaagctgcaaaacaaattatagtttcttttttttttttttttttttttttgagacggagtcttgatctgtcgcccaggctagagtgcagtggcacgatctgggctcactgcaagctctgcctcccgggttcacaccattctcctgcctcagcctccccagcagctgggactacaggtgcacgctgccacgcccggctaatttttgtatttttagtagagacggggtttcactatgttagccaggacggtctccatctcctgaccacgtgatccgcctgcctcggcctcccaaagtgctgggattaaaattatagtttctttagaaacaatgtcaggtgttgggaagaaggtagaaagaatgtatcaaatgtcttaacttacgcatgaaaggagggttgtgagcacgcttcagttttgttactgatagaaaaataaaggttcaatacttgtcaaaaatgtaagagtaaccactggtcagaccagaacacagaaagagagcttgcaaaccctccccagagaggaaacagtagcaaaaaccaaaatcaaagcacgttttcttgctctaacttgtgaaagtcaggaaaggaaatgtttcagcagaaaaggagaaatgatacaagggcaggagccagccagaactgacagaggcaaggacgatcgtggggctgcgctgtctccttcatgagataaaaaccgaagacgtcagcgtgaccaagaggaaactccagccatagcctcttgaaagagcgtaccttaaaccaacgcctcagacaggtggtaaaccgagagctgtgtgcagggagctggggtggacgcaaacacagaggagtgaggacggaaggcacagcggtaacgagacagagggaagctcaggcatgtcacccaacgggcagcagaaacgaatctctaggagcaggtaacgtgtcctggaggtgagggaagctaaaactattaaaatggcaaggagaatttggcaaaccagagtcagagagagacaaagactggatggagatacataggtagactgtgacagctcagagggacagaaattgagcaagggtactgtgggtttgaagagcataatgaacaagcctcctttgtttttttttttttttttttttttgaaatggagtttcgttcttgttgcccaggctggagtgcagtggcgccatctcagctcactgcaaaccctacctcccgggttcgagccattctcccgcctcagcctcccgagtagctgggattacaggcatgcgccaccatgcacagcttattttgtatttttagtagagacggggtttctccatgttggtcaggctcgtctcgaactcccgacctcaggtgacctgcccacctcagcctcccaaagtgctgggattacaggcgtgagccatcgcacctggccacaagtctgctttaacatgccaaatcggtactccatagagaacacacattcctgtccaatgttcctggaacaatctaaaagtggtcacattctggattagaaacaaagaaaatctcaaattccaaaaacaaaaggcagaaactgccaggcgcagtggctcatgcctgtaatcctagcactttaggaggctgaggtgggtggatcaactgaggtcaggagttcgagatcagcctggccaacatggtaaaaccccatctctactaaaaatacaaaaattacccaagtatggtggtgggcgcctataatcagtcccagctactcgggaggctgaggcaggagaatcgcttgaacctaggaggtggtggttgcagtgagccgagatcgtgcaactggacgccagcctgggtgacagagtgagactctgtgtcaaaataaataaataaataaataaataaataaataaataaataaaattaaaaaataaaagtcgtcacattctaggttagaaacaaagaaaatctcaaattccaaagacaaaaggcagaaactatcagtgtgccaagtctaaccacgatgcagcaaaaccagaactgcacaccacgaaaaggacaggagggaaacctcagcaccttgaacagtgacgggttgaaagaaaataaaaccccaaatgatagactatttaaaaaaaacacagcaatgaggacaccccacatctcaaactacaagatacctagccaaaggtatactctgaggaaaatttatagctttaaactagagtttcccagcctcaggactactgacagtccaggctggataactctttgttatgtgtgcaggagcagtcctgtgttgtaggaggttcccagcatccctagcctctacccactggatcagttacatccatcaatcgtcacaaccaaaaatgtctccagacatcatcgaatgcttcctgtgcatcaaagtcaccactggctgagaaccactgctttaagcctttttgttgggaatgaagacagactaaaaataataactcaagaagctattttaaaaaagtgataaatcaaagaaagtggattaaagaaattgaatattagaaaggaaaatctctcctcccaactaaagaaagaaaaacctcagcaggtcttatcaagagaactgcacctgtacttcgaacagaccaataaactcaacgaacctctgttaggtctgatcaaccaaaaaaaaaaaaaaaaaaaaagaagaagaaagaaaataaaaataaaaatagacgagaatagaaatgaacagaaattttaactttataacaggccactgtgcataactttatgtcaatacattaaaaaatccaaacaaaatacacaatttgctaatacaaataatcaaacctgacttaagatgaggaagaaaactggccaggcgtggtggctcatgcctgtaataccagcactttgggaggccgaggcaggtggatcacttgtggtcagagttcaagaccagcctggccaacatggtgaaaccccgtctctactaaaaatacaaaaaattggccaggcgtggtggcaggtgcctgtaatcccagctactcgggagactgaggcaggagaatcgcttgaacccaggaggcagaggttgaagtgagccgagatcgtgcaactgcactccagcctggacgacagagtgaaactccatctcaaaaaaaaaagatgaggtagaaaattgaatacaatagccacagaatacattaaaaccttaatttaagatctctgttgaaaaacaggtatcagagaccaggctcagtggctcacacctgtaatcccagcactttgggaggccaagacgggtggatcatgaggtcaggagatcgagaccatcctgctttaacacggtgaaaccccatctctactaaaagtacaaaaaaattagccgggcgtggtggcgggcacctgtagtcccagctactcaggaggctgaggcaggagaatggcgtgaacctggaaggcagagcttgcagtgagccgagatcgtgccactgcactccagtctgggcgacagagcgagactccgtctcaaacaaaaacaaaaaaacaaaaaaaaaagaaaagaaaaacaggtatcaggactaaagggttttgtaagtttgaccagacttttaacaagtaaataatttctgtgatttttaaactgattgggagcataaaaaagtgtggatgatttcccaagtattttacaaaaccaaaacaatctcacttgtgaatttagacaaaataaaatattgatgttcaacactgtgtccccattaggaaagacaatacaattcattgtaatgaacacattgaaagtgaatactgtacagccacaggtaattactgagtgcttactatggcccagtagcgaaaagataaattgtcagtttacaccagggattagcaaactagtctatggactcctcgcttgcttttgtaaataaagttttattggaacgccgccaaccccactcatgaatacgcgttctatggctgcttgcaagctacagctggtaacggtagagctgaggagtttccccacagggaccacacggccctcagtctatgacatttaccgtctgggccttttccgacagtttgttgacccctggtttacactattgatgaaaaactaaacatttccacataaaaaaaccatcacagaaccagcagacaagagaattcctgggtaagggaggagcatctacatccgactcagccagagattcggtagaacaacgtgggcagattcacctcaaaatttacaaaatcaggacacggaaaaaagctcccccccaaaataaggggcaaatgacccatcaggagaaaaacacacaacttataagaaataggtgatacaggctgggcgcagaggcttacgcctgtaatcccggaactttgggaggctgaggcgggcagatcccttgaggtcaggagttcgagaccagcctgaccaacatggagaaaccccgtctccactaaaaatacaaaaattagccaggcatggtggcgcatgcctgtaatcccagctacatggtaagctgaggcaggagaatcacttgaactcggggggcagaggttgcagtgagctgagattgcagcattgcactccagcctgggcaactagagtgaaactccatcaaaaaaaaaaaaaagaaagcactcgaaaagtcaagaagattcaagcttacagagtagtcaaagtgcagctaaaaatgacacaatatcgtgccaggcatggtggttcatgcctgtaatcccagcactttaggatgccaaggcaggcggattacctgaggttgggagttcgagaccagcctgaccaacatggagaaactctgtctctactaaaaatacaaaattagctgggcttagtggcggatgcctgtaaccccagctactcggtagactgaagcagaagaatcgtttgaacctgggaggcacaagtggtagcgagccaagatcacaccatcacattccagcctgggtaaaaagagcgaaactccatctcaaaaaaaaaaaaaaaaaaagacgtcatatcaaatacaatctaagtctaagaccccactcactgggaaagatgccatgcttgtatgtcccgtcatgaaagggaaaaaccctaccaactagactgtgatatgccatcaagcaaaagacgcatcccaattccagaaacactaaaaagcaagggaacatggctctgacttgagaatattttttgtctatcaagccaagagtgatagactgctatgtggtaatggcaatgatttggtcagcaggtgccatgctgctctgtggctgtgactgtatgctgggagactctttttttttaaatttattttttgagatggagtctcgctctgtcacctaggctggagtgtgatggtggttctcagctcactgcaaccaggttcaaatgattctcctgcctcagccccccaagtagctgggattacaggcacgcaccaccacgcctggctaatttttgtatttttagtagaaatggggtttcaccatgttggccaggctggtgtctaactcctgacctcaggtaatccacctgcctcagcctcccaaagtgctgggattacaggtgtgagccactgtgcccggccagttttctacctcatcttaataatgctttatcacagcataattaaaaaaaaaaagaacctagatttccaaccactgggggttgtttaaataaatacttcattagtccctatgaaatggaccacaagacaatgtgtttacaggattgtggttgggatgtaatcacaggacagggtgcagagcgcatgacgaagcttgtgaaagagaagtgcttgtgtacagagagcattcaagcgctgtgcagagctgggggaattgtggataactttttgtttttgtttttctttttgagatggagtttcgctctgttgcccaggcgggggtgcagtggtgcaatctcggctcacagcaagctccgcctcccgggttcaagcgattttcctgcctcagcctcctgagtagctgggattacaggtgcccgccaccatgcccagctagtagagacggggtttcaccatgttagccaggctggccttgaactcctgacctcaggtgatccacctgccttggcctcctgaagtgctgggattacaggcgtgagccactgtgcccaaccaattttcttttttttttttttttctattttttttttattatactttaagttttagggtacatgtgcacattgtgcaggttagttacatatgtatacatgtgccatgcccagttttcttttttgaaacaaggtctcactctgttgcccaggctggagtgctgtggtgtgatcatggctcactgcagcttcggccttccaggctcaagcaatccttccacctcagcctccggagtagctcgaactacaggcacacatcactacacccagctaatttttgtatttgctgtagagacagggttttaccatgttgcctgggctaacttttttctttggctttatgctgacctatatttccgaaggttttccagtgtgaataggcataatttgcataaaaagaaataagccaaaaataaagtgaccaaatgaaaatcctccctttctccaggaactttctgtgaagccgcccccatggctccagggcaggccggggacctgggggcctcaaggacacttactcacaatctggccggctggcagcacctgctccctggtgtcattggaggacgagggcgtcgctgaggggaagagacacgcatgttggccaggtctgctcagaaccctagcaccctacaccccctgccacccttggtctctcagcacaatcggagatgcaggcaggataacatggtccatcccggggaacccctccaccccctgcagggctcccggagtccagcaggcagtggtgtctgtttggatgcccctggcaggtgctcacggtagcagcttgggaagcccgtgaagccctcggcacacacgtcacaccgctccccagagaagttgggccggcagtagcatcgacccgtcaggtcctcgcaggtgccatccgtgaagtcggactcgcagttgcagcctgggcaggggcaggagccgggtaagcctggagctaccaggactcaaggggtgggctccaagatgtggcagtctctacctccccagccagggccatggggatgagggctacagccaggccccctggggggacatgagggctggggacccgccccgtggcctgggaggctccttcctgggctggcctggaagctcaggacatcccctccaaagcagccccaaaggcccaagaacacctctttccaggcagaccctgagacccaggacacccgcccagctgagcccactcacggcggcagacgtggggcgagtcgagagggtggttgggagagcggtagaagccgggcaggcagcgctcacagttgacgccggtggtgtggtgctgggagtgcaatggccgttgagtctggggaggtccctgccccacctcagggccagcccattcccagccctctagcccagcccacctggcagtcgatacagacacccccaccctgataggtgccatccaggctctggctggcgcggcgccggtccacctcagggtcgtagtaacagtcggtggcatggccgtagcagttacaggctagagagaggggagcgcagctgttggcacgccctccacaggcccgggcaccggggccctctcatgggccagggtgtgggcaggacacacgtgtgtgggaggaggcactcacactggcactcgttggcactgttggcagtcgcaggcttccacggctgctgattgaagccggggcagcagcggtcgcaggtgcccccgcaggtgttgtgctggcaggtgcactgcagcctgtggggtacacaggaggggggatcaggcccatcctggaggcaggtggcaggtgctcagtcccttccctgaaggggcctgtgatcccctcgatggcttggcttgccacatggacacggccccccgctgctgtttctccagctgtccggcagcaagcgctcgcccagactcagcgtccccgagcctgtggctctgacgcaacttccccaggctcagggaatggacacaaggaaagaggcggtggaggacagggtctcacagggcctttgtggaggcgggactggggagcaggtgtgcactgaccgggtggggcctaggacagggcacctcaggggtcagtagagtcccccttgcctgcaggtcaggatggagacctgcgttctccaaaactgagttatgccctttccacttcggccaggactcgagcgtaagcccaaaacctccctgagccagaagggaaaggggtccatttgcaccccccaaggctcagatttcgcttagcaggcaggactcctaggcatcctggtcacctccctagggccaagtggccaagaactgcttccttcttccagctggggtggacactaagtcacagggctggaatcttgccttacgtcccgtgggcagggtgacagctggagagagacaaggcctgaggttggaagcacctactgctcagtattagccagaccacagcgggagtccctgccccagatcaggctctgccggaggctgcagggccgtgcgttccctgagcaggaccccagaagtcagtccagtccatgaggattagacccagagcctcaaatggtccagctctagtcctgtcctccacggggcccacctcacagggcctcgggaatcaatactgctttccctcagaatccagaaacatctgggagggccataccctcaatgagaggaattgggaaataaactgcccgtcagcacaggtgatcaacaaagaagctgctctgtcgtcacaccagccccaagtacctataagcaagggcctgaactggtgttccatttttcaaaaatccacatagtcaagaaattgataggaaaagtggtgccgggctggcgataccctggggtgtatagcaaaagctctcccaaaaccatcccaatcccagggcacgccagaagcacaaagataaaccctgctaaagaccttgcagagaaacaatgtggcaggtcagcagaaagagccccaagaacctcacaaaatggagtaatctagtagaagccagggaagaatgttaaaaatggtcataaagaaatctaaaacataggccgggcgcagtggctcacgcctgtaatcccagcactttgggaagccaaggcgggtggatcacgaggtcaggagatcgagaccatctggctaacaaggtgaaaccccatctctactaaagaaaaatacaaaaaattagccgggtgtggtggcaggtgcctgtagtcccagctactcaggaggatgaggcaggagaatggcacgaacctgggaggtggagcttgcagtgagccgagattgcaccactgcactccagcctgggcaagagtgtgatactctgtctcaaaaaagaataaaataaaataaaaaagaaatctaaaacataataataaaaaaaataacactatggaaaacaggcagatgtgaaaaagaaccaatcagaacttctagaaatgaaaaatgaaactataaaattaaagactcaatggatgggctaaacagcagacagacacagtggaagagagatttagtgaagtggaagaggagcaaaggaagctatccagaagacacctcagaagataaagagagaggaaatagaaattatgagaaggaaaccagaaggtgctcctgtatctaatggggactccaggggaaaagaggtaggaaagggagccaacagtcagaaagaatggccaaggatggtcttgaattaataatgaacacatggccaggcgcagtggctcacacctgtaatcccagcactttgggaggccgaggcaggtggatcacgaggtcaggagatcgagaccatcttggctaacatggtgaaaccccgtttctactaaaaatacaaaaaaaaatagccaggcgtggtggtgggtgcctgtagtcccagctactcaggaggctgaggtgggagaatggcatgaacccgggaggcggagcttgcagtgagccgagatcgtgccactgcacgccagtctgggcaacagagtgagactccatctcaaaaaaaaaaaaaaaaaaaaaaagcgtgagtcctgagcaagaaaaaaatcccaatcctcaacacatcacaataaatctgcagaacaccaatggcaaaaagaccataaaaagtcctggagaagaagatgacccacagaggatcagcaactgcaaggacaatggactctcccaagcacctggagaggtgaagagacagtcaaatcatttctccaaagtgctgagagatgcagctatcaaccacgaatcctacagtcagctcaactatcattcaagagggaggacaaaacagccgttttcagacaattccggatagactgtcatggaatagaaaaactacagggtgcatttcaggaaggaggaagcagcaacccaggggatggggatggggatggggatggtgggggtgatgggggtgatgatggtgatggtgatggtgatggtgatggtgatggtgatggtgggggtggtgatgggtgggggtgatgacggtgggagtgggggtgatgacggtgatggtgggggtgatgacggtgatggtgggggtgatgacggtgatggtgggggtgatgatggtgggagtgggctggtagtgggggtgatggtttgggtgggagtaaggtgatggtggaggtaaagaggcagaaaattgctggctgatgacatggagcccccttccctggaggagaggtggggtggcgggtaaagggtgcagggagaacatgggcaggctaatgttttgggacactggtgggtgaccaggtcctggtaacagaggctgtggttccatgaaagattcccagtcacccctgcttgcacctgcagggagagctgagctcagtccacacccaggtgcggtgagtcaggggatggcaatgtcttccctgcaggccaaggcaagccccggctcccgcgcccttcctctccttggaggcccatttggctgcctggtgggttccactccctgctgtcacgagctgcgtccccacttggcacttaatttcccaggacaagttagctctgctggagctcagcacctgaagctgtgctggcagcaacaagtgcctgggtgggtccccagggcccacagctcctggcaaacagcccaagtcctccggctcaggtgactgtgccactcctcccctcagacccaccagccacatccgaaggggcccagggctcccgcctctgctcggcactggccgtgagaatgggagtgaacctttgtcctgtctgagctccacccgcctccccacctcccctgtaaactggagcgtggacagagcagtaaggccccacagaaggcaagggcgggtcccaaatccaagcgcatgaaagttgggctgctcggttgcaggcactagatgagccctgccagctccctgctgggggtccaggagcctcgtcacacactcagcctcagctgcaccactctgagtggcttctgtccagccccatgcctgcactgccaccctagggtgttacaccctccgggcaccacgctgagtactggtttgcgtgtttcccagctgcctcccccggaacaggtgctcctgaggccgggctggggtcccaccctgtgttcccattcccaggaaaacggcccagcgtgtgttaggcgctcaacatacagctgctggctgaaagaaccaacgaagggagggaggaaaggacggacgtgccctggggttgcttctccgcagaatgagcccggccctaccttactgaggactctgggtgaggcccaggaatgtgccggtgccagcaccagggctgctgcccatcctgtgaggggctcccgggaggtggatgctctgcagtgccctcggctgcccccgaaagcaggcacacagggcacagcagatgtggggtgttggctgcccccaccctgccatccccgtcctgggccttggtccctgcttgactggagtgaaggtcagggctggggcagcagggaagttgtctgttgtgtcctgaaaggttgggggagctgggcgggcacccccaaagtgaattagggctgcctcggcaggtagtgggcacctgtccattccgggggatgcagtcttggagtcggggatcaatcatccccattgctgactcccctccacagggccccaggtgtccactatggtgggaaggccagctggcctgggggtccggagagccccacctctgctggcagtagggcaaggccccccaaaccaagatagggcaccctggggaggctgcacatgccctggcctccacatcactgcacagatgaggaaactgaggcacacacggcggtggtcagtgcaggtcacacagacagcagggttgtggtgggccatggaaccaggtcacccaccctcaggttaggcaggggtgacaaggacaggcagggagctggggggggcctcacctgaacggggcctcacctgaatggggcctcacctgaacgggtccgtggggtctttggcatcgcaggcatccgcgtggccgtggcagacacagcggcctccgatgctgatatccttgatgctgtaataatactgcacccgcaggccccgtgagcaccaggcggccaggcctcactcaccctgagtcccgggtccacccggccagtccccctcccccgcctgcgccatgggcagctcacccggcgggtgaccgtggggtcccgcagcgccttccccatgagatggcccagcagcgtgttggtacgcaggaagcgcaggcggacgttggtggccttggtgaactcacgtagcagcggcgagtaggagaaattcatggcgcccggacgtccgttcaccagggacaccacgatctgtgggcagtatgcggtgacgccagtgtggccctagcccctgctcagcactgcccctcccgggcccacctttcccttctccagccccgctcggcactgcccctcccctacccacctctccgttctccagcccccgtaccgccctgcccctccccggcccacctctccgttctccaggggcacgatgcgtgagtactcggtggtgcagatggccgcgtcgtcccgtgtgatgcgctccagcgtctgtggcccgaaccgctccagacagtccctcttggaggctgcggggaatggcgggaggggagggcgctggatcaccagaaaagcctgggtccccgcggtgcccgggccccttgacgtctccgggccttgccactgaggctcccacaggccaagaggccgcgtgacagagaccacagctcactggctgaaggggcctggcccgttggactgcactgccccccaccgctctcccttgcacgctttgagtgcgagtgacccccctcgacgaccatcctcacccccttccttggggacagacgcctactgcccatcactgacccgcccctcccccattctcaggccagggaattttgggggacacgtgaccaggcctgccctattggggaggagcacccactcccaccagcatgactggtcagggtggcacggggccagggacggccagcatccgggctaggactccagtactcttgacgcaggtggctaggctggcaggaggtgaggtgggagctgccaggccccttttgtcaccacgggagctgccggtgcatgaagccatccagaggcagccaagagatggcaccagagattcctggcgccacagcccctggacttggctgtgcccgacgccagggacaggagccaataaatccccatgagccttcgggtcctcgtctgacagtcatgaccgcagcagccgggtgtgagggcagggctgggtattcggagaccttcagaagcctggtcacggagggcctgcccagggacccccctgcctctccccccaggccccacggcggcagagactcacaggcaaagaactgccagggctggtaggtgcggccgaagtccatggaccgctccagcacccagaggtccggccggggtgagttggcaaacttgatgaggacgtaggccacgtggaagacctgtgggccgagagggcgtcaggggagccaggggcgcctggattcccatgctcccaggggcctggctcattttctgcccctcaggtgaggccacagcaggggatgtggcaccctcgccgcacagggggcacctctgggtttgcctgtgtggggcagacgaacccaggggagagggctccccagggatggagatgagcccccgggaaccagccctcctggaagggctccccgcctgggctcgggaccaacgcgctgcctcctccccttccctgccgcaggagtttggggttcccccatggtcctgcaagctctgtggctgcagatggagcaagctagggagaggcctacctgcggcccaggcagggactggccagggtggaggcaggaacacaccccagtgtccccacagccctcacgtccagccaggcctggtggccagacagtggtccctgccaccaggcaggtccaaaggtccaaccccctagtccctctgacaggtcagcagctcctaagatggggcccctgcccccacctcacaccgggcacccctccccaggctctgctcagtcccatgctgaccagcccacagccaggggcccactgagcccccagggactgggctgcagggagcaagcggggctcagccttgcaggctgggggccctcttgaagctgagtctgcctcggagactccaccagcccaggcactggggcagtagcactgctgtggcccggtgcacgtcagggcagccctgcccagggcagaggaaagctgctccttcccaggcctccgaaaccccaagcccctgccccagccccaccttggctctgcctactttctccccgtgtgtcagcctgacctccacccagggacagcccatgtgtctgtgcctcggggctgggggacagcctggctcagtcttcacaggacgctttgtacacctcctcagagaagccttccctgactgcagcccctccccctaaccctcagctgcggacatctccccaggcccaggcccttctctccgcacaggccaggcctgctgactcccctcaggcctctgatcagcctgggcttccctccctccctccctccctccctccctacccatcccctgacaccctgccctcaggactccaggcctgagcctctcctgcccccagcagtcagtgctacccagcctcatatctgcacccacccgacatgaccgtgggcctccatgcctgcacctgggggtgcacacacacccgcccaacagtgaaacaccgtgggggtggctcctccatggacccaggccacaggccccctctgaaaaggtctctggtccctaaaaacagcccatggcctcaatggcaagaggctgcacccaggagcagggggggtcccgaggcacacaggagggggcggtgcccaagcagcaccccgccttcacactcatgcaagccagggctcagcccctgctgcagccaagtgctcccacccgccatagcctctgaggggagccctaggctccccctacctgggggcaaaggagggaagttgtctccaggccctgtcacaagcctggaggctccaagggagggtgagcccctccccagcccctctcaaacaaaggggaaagggctctcccaggcagaggctccacagggacctggcagggaggcggaggaaacacgaacctctcccccgcctgtgcgaggaggcccgggtgccgggggagagaggcaactcatggacccacagcacaggtgtggcctgcctgtcccggcccacacctcccctgacgggcccacagggtccacgatggagaccttgggagacctcagtactcagcccaactctttgtgggcggcagtggggaccagcccctcctctgctcacaggtgggcacccaggtgggccctaaaaaggccagcaggcctccgagggtcatgccacaccccagggccacccaccacacctcctcgggaccctgacccgccagtgcccactcctccggagagtttctccccacagcaggtacgcccgggaacagctgggtgctgttggccaggtaggcctggaagcctagggccccaagggggagagtggggtcccccagagctgcacaagacctacagtcaccccactggactgagccggactgagactgctgtggggtcccccatgaaaagaccacagacccctcatagcttcagcccttgggggcaccagctgcccagactccaggtagggggcaaggttccaggactccagacatcccaggtccaaatcccacccttctcggagggcttggcgttgcggggactgtgggagccaagcgcagccttccggggttggggcggggcacaggcctattcaccggctgccaggctctgaggtcatcgtctacctccctgtgggtggggggcagggagacatgccctgcccagcagggaggggtatgagcctcttcagggacagaccctatacccagccccacacccgggcctcagcagccccctgtgggcctgaccacaagcattccagagagccccaggtgggggccagtggcccctgtgcctggacagggaaggacccgctagaggtggacaggggcagggacacaggctgttctcggggagctggcaacacagcccctcccaccaaaggctccgaaggagactaaaggtcccgactgagccccctgggagccgcccccgctgttccctgagtgcctggatggaggctgcgctctcctcggcccgatctgtcctcctccctccccttcagcaggccagtcacatttttcccagctgagagcacttgcacaaatattgacttgaagacactgatcagcaggatgagggggacacagacacttcgccctccccacccctgggatgcacaggaagatcctggcctcctgtctgtcccccatcccaaccatctgtctgtcagacaggggccctggacagctgtcctcgagggcctggtggctgcacagatggtcacaggaagggaagcccgcgctggaggactcccatctgtctctgacctggtcgcggctcccagggccacaccggccgccctcgccatgacccggagcgagcgcagacccctggcttcgggaccgcccttccccctccacgccccgctcagctcagctgccagtgctgacctttccgctgctacatggttctgtgcagaaagaaaaaaaaaagtcttttaaagcaaaagccaaacaaaagctgcctgagttatttttaaaaatcggctattttggggcaggcacgtctccaggacggcagccggacccgcctctcagccactgcaccctccagtccccactacccagcttgccctgggagggccacggttcccagaggaggcctctgcccggtgaccactgcctcacagggggtgggcaagagccccaggagtacggggcccaggacccagggcccaggccggctccaggcttcaggggttgtgcggccctggagcggacacttccccttcctgggcacagggcagtgggaagagctgcagagaggggcatcaggataaaatgcctttcatgagggcatgaaggtttgagcgccctgggagggaggacgccagctgctcctggagggcagcagccaccccgcagagacgctgagaggcccccactggagctgccccactcactggcgctccgaaggcaaagctgcggaggggactgagtaggtgctagggtctgggcagcacggtgaggactacagagaaactctggtggggctttcggggaccctggggatggcgtggggttgttggctagcagcctcctgggctgaggcacccacctcaccatggggtgggctgtggctggaacctccagaggaggggaggcggtgctgtcctgtgcccaaacccagctctgccctgacccatcttgggttggggagaccagggccaggtccaggtgcccgctgtgctgggtgagggccagtcagccttccccggcagcctggatcacagcggtctgtgactcagcccccgccctgcaggaagaagggcgttgtgccaattcccggggcaggaaaagcccctcctagccccaggcgtccgggccagcaccctgatcgcactgctcggacagggcaccggggcacccagccccctcgatgcccagagtcctgggccagcccagcccttgcccgctcctgctgtgtgcctcccctcgaagagaccccatctggaaacgtagataagccccacagcaggggcggggcggcagccgggagcatctccactggcccccagctgggtgaataagcacggcggccacacaacctatcaggggtccggaaacgtgccccacacagacacctctcccagagggacgtggagtggaaaagccgggggtttccacagcaagcccaccgctgggaagaaaaataacaactctgaggccagaacccccaactctggggttggacgccgccatgcccaactacagatgtcctaagcaggacaggaaaacttccaggagtgggcggggggacaggagctccccagctggagggagaggatgggttcccagccagggggctgcccgcacctcaacagagctgggcctggggtggattcagggaccccaaccactgcagcccaagctccaggctccctccctgcagcccagcccaggtcaggccagatggtcagccggggacacaggaagtggagattatcccaaggggacccctcggcctgaaacccaaacagtttcgtcttcactgagctgtgttgtcagaggccaatgtggtggctcttgtttagaaacagacagaaaacaggaagcctttggggaccaccagggcctggggggtctaggtgggtgctggggcatctctgtgccctgagtgccaggtctggccgtgcagccaccaagggcaagcatggcgcgggggtgcggggagaggagcggccccatccccaccttggcatggcagccccttgggccgtgtcctccttccaggacacgtagagggagggttttgccgtctatcctgtgccaggggaggggagtggtgcctcccaggacccccgccgtaccccccagggagccctgctcaagtggctgcgtctggttcagcccgtgcacctgtcccggccgccgagctctgtaactagagcctggccgcagctgcacttcctgtccttccctggacaacccactgaccgtcctggggcactggccacatggctgagtgcccaaccaggcccagggagccaagccagtggcaccctggaccagtaggcctgcccagggcccaagccggccagccagagagcaggcagtcctgaagggtgaggcagcctgggcgcgctgggcctccggcaggtcctcctcctgcggtgctcctcccatttacagaggaggaaccagcccgggaacccagactgcagacagcatggccaaccccacagtcctccagaccccagcactgggaccttgggcactccacactggccctgaccctctcataaccccacctcagtttccccaagtgcctagggaaactcacactccagtggccaatgacttcagcagagctttgcctccttgtacccccacttggaggggacagctgactgcctcccctctccggccctacctgtccactctgccctcccatgggtctccaccatccccaggggcacaggccctcacctggcactgctcgcccccaaccaatacttctagcctcatgcctaactgcccccttataccctgccagccccagttcccccacaccttgacccccacctgggcctccccatttgccctgcagctctgggcctcggggactgggacaaagccgctaccccacctgtagcacctgcagcgtggcctgctctacagagaacaaagcaggggcctccctaccggaagggggcccgtgcgtcctcactcctcatctgagggaggcgggaggcaatgccctcctctgctggggagagccccgcccccacggtcaggccacccaggggccgactggagagggaggggacacaggccagagccagccccactcaccctgcccagctccttacaacctgggcccgctgggctagcgtgctggtgtagtggggcaagggcctggaccctgcggcagagccagggggtgggggagctcaagccaggacccgctggccatgtgcctgggcagtcatgaacgcgctcacccttccctgggcctggggcctggggcctggggcctgggtgtggttctcggaagaaggagcctgaggccagtgatgtggccgctcagttccagaagcttccggaggatgcaaggagatacgcaagaaccccctagaaggaccccctggggaaggtcacgtctggaactcggaaactgccccctgagtcaccagtgaccagcgctggagcctcttcctgaggccccacccttggagagagaacccctccacggctgggcgcagcgggacccaggccaggagcccagctggcactcccgggggcccaggctcagctgcttctgggtggacaccacagggactagtctcccctcccctgcgccagcccctgccccaccgcacaccaggggtatgagatccgaaccgtgatgcagcccaccccgccctcctcagccttccaggagcaggaagccttcccgatgcccagtgccagccgcccccacccccgtcccagggcatccgctccagatcccagaacaaaggctgctggcagcccgctgcagggggagtgcccggacccacccgccgctcagcctggcttcctgatggaggccccagccccgccccaggatcagccctgaagcccaggaaggacatttccccaccccactccagggagtccctgcccccaccctgaccaaggctggcagccccctggcctaggccgagacaggggccttggtagatacatccacgtggtcaggaaagtgggtgagaaggaaggaagacggtgcaggtgtggagggaggaatgagcagacaggtggacagatggatggaaacaaggaataaagggtgggtgctgcataggtaggggggtgggtgggtggatggatgggtaggggtgggtgggtggatacgttgggggtgggtgggtgggtgggtcagcaggcagagggatgggataggataggtgggtgggtggagggatgggtgagtgggtgggtggagggatagatgggtggtgggtgggtggagggatagatgggtggtgggtgggtggagggatagatgggtgggtgggtgggtggagggatagatgggtggtgggtgggtggagggatagatgggtggatgggtgggtagaaggataggtaggtgggtgggtgggtggatgggtgggtggagggatagatgggtgggtgggtgggtggagggatagatgggtgggtgggtggagggaccacttcccaggtggagtggaaagggttcctcttccctccgtatcattttacagttggtgaaactgaggctgtgagaggcaagacgctcacatggcggaacctgatttctggcccagaacaatctaaaagcaaactggcttcaggcctgaagtttccagcccagttcatacatgtgcaccgaggccgagagagccccagagccaaggggtggtggagcccaggctcgtgggtccgagtgtcagtcccggcttccctgccccacccaggcacatcgggcactgcgcccactggctctgcagccaccctggggttgccgtggagactgggccatctcccctcccccagcccagccccctagtttctcaaaggaggagaggcgggaagaactcgccagtgcccagcttcccgccccgagcagctgagaattcacacgtacgctacagccaaggtgggggcctctgctgctgtgccagagagatgagggacccccaggctccaggggacaggggagtcagatgcggggaaacccagtgagatgaaggtaaacaggcaaagccacacccagacccaggccagggcagggctaggggcctggcaggcaggcagggagcccaggacaggcaacccctccccagctccccgcccttctccacagggctctgcaagttcaggaacccctggaaattccaggccacttttggagcttgagccctcccctcactgcctgcccagcccgggccaggcctgcagaccaccaaggctgccaaaggtgcctgccccttggggccggccctccagccaggctccagggagacctcctctatctctaacaccctcgggacaatggcagggacagaggctcagacaggggtgaagaccgatgtgtcacacactgggactggggcagcggcggagccggctgggatgcaggcctctgggtcagccctggggcccccactccaggcactggctgctctcaggcccagcctcctccacctgccccaccactgtccctgacctaagaagcaccaggattactggcccattttacaggccaggacctcaaggctgggtacccgggccaagtcgcccccaatctgggggtgctcagggctggcagccaggcaggcccaccttgggggtttcactcttcgcttggaggcacccagctgcagcctcctgcttgtgcaggggcctccaaggccaaggagagcccagagctggggactggagagcaggcacccgaccccacctaaccctcagtggccgccacctcggcacaggtatcccaggaatgtccacttgcgccagcctcctctgcattcctgcagcccctcccgcacctgccaggaattccttaaacagcagggcgcctgacgcagggggcaccaccgcactgctcacagcacctccgccctcccagccccaagctgtctactcagcacccgcaaccaaactctgtggcctttggaaacacccccatgagcacccgctttccctgtgtcatggggacgctgaaagcacaaacaaaaggtgaccactgccgtgcctttgtccctgtggggactccccccaccaagtccttcgtgtccagcctcccaggccccaggtctcgctcacggtggagacctcgccttctggtcctgtggcccaaggtaggcccgacgggcacagacacagagatgggggctgcagcacgcaaagaagggtccctacctggcccaggtccagggtgacgttgacctcgttgtactccaggccgcgggacagcggtggactctgccaccagcgctccgtgccatcgatggcattgctcgcggggtgtgccttgttgctgttggcagccgtgcagatgtcacagtactggccctgcagagggaacgggagggtcagatagccgagaagggccggggcccccttcctcctccacagtcaccctgctgccccgagacaagtcctggtcccactgagctggttccacgcccagcctctgcgcccctcatccacttgctcagcaaacatgcgccaagcacctgctgctcctccgactcaggggatgtggctcatgtgagctgctcacggcgctaaggacaagaggaagaccagggtggagaggggcatctgccttgggtgggaaaatctcggtgggcctctctagcggggtggcgtctgagcactacgtggtaagggggggggtgtgctctaggcagagggggtgccagtgcaacgagccctgggggcaggaagagtctcacagtaaaccacaaggtggatcaatgtgtctagagccaaagggagcaagaaggggcaggagtaaggcaaagcatggctacccctccctgctggccctgccaggggctccagagaggcttggacaaaatgcagcaagccagggggcggaagggggagctgcagacagaaggaccgtcagggccgggatccaggcggccagacccccccccacctccagatcttgcccacagccttctggattagggtctccagagagacagaattaagctgttccggaggcctgtggggaccggccccagagtggacgtgtggacagcggcaggtgggcctgggcctcctggctgctgcttccgagtcctgggaagaggccaagtcacagtaactgctgagcctcaatgtccccatccaaagagtggggataaggctgcacctgcctggggccaccgtgaggagtaatggctcacacacacagcctggcagccgcttctgtcccgggcctgccatctgctgggggcctgtcctgcatgggtgagtggggaagagaggaggctcccagcagaatcctggcctgcatcctggcaggggaggggtagtgctgggagccggggcagggatgaggagagggggcagagctgggtcctggctgctcccccgcccccccaggaaaccagatctgctgtttgtccacacaaaggcgccctcccaggcttggggttgattgaggccccagaggcctcaatctgagtttgagaaagtcagcggccctaccccgcccagcctcccttggggggccagacctcatcctaggaggaggaggcaggagctggggagatgccttctccccacccccaggcccagcacctacagagggcccaaccccctcgcccagagtgtgccctctgcctccactgagcaccagggcaacacccggtacccctcccacaggctcccaagaccccgccctggtgtttggattgccccatctcagaccttgccccagaccacccaagatgcagctctgcagcccccagtgtggccactgctgtatttcctttactgcatgtatgagacctggaattatctgggggcctccccggggtcccccagagctctgcagtggcagggtccacaccctccttattcccgctgtgtccccagctcaccacctaagcattctcgtggatggggctagagcaactgaagacacccagttaagcgccacgacccctacccgcaggccgcactgcaagctttgatggtggcccccaaactcaagagctcaatgacagcacggcgcacacaggtcctgctcagggtggggccaggggctcctggagaaggtaggtgtgggcggcgccctctggctgggacagccggacctcccagggaaggctgcttgctggtcaagaccctcccagacacacgagcagcagagggaagctgggtggaaggttgcgggtcaagggtcagcctctactcttccaggaggtcagggaagcacctgctcagtccctgcctgggccagcgttggtccagttattgggaggcagttccagtccccattcggccactcactgagccacagaggacagggttgggaaaaccaggctcccccacctccgctgcggagggtcccgtgagaacagagctaggaaacagcagaagggccgataaggacttccccttccaatgagtcaccatgctggcctggctgcccagtccccaccttcccaggctgggccggccagggatcccctgatgcccacctggggctgtgagggccacaacctccccctgccctctgcctgctccagctgcccagcagggttcaccccgacccccatctgggatgcccagctaatgtgcatctcctacagagggtccctgagagcccctggcctgcagccttgagaacacactgcccagccccaggccccatagccttagtgagccccctcagatggagctgcggcttcatcgcctgggcacctcctgtgcctgcctgccttgccccaaccgcagctccactccagaccggccggcaaggacttctcacacgcccaatccgcggccagggcggtcagcagacccgcggctctcagatgaaggaggcatccaaggtcatacccgtccagctcacgtctaccagctgatctttctacatatctggcagcctcagcgggcactcactgctcagagctcgagactttggaagcgaagggttcacctctattgctagacatgagctgggcgaggccggctggtttctcatccaagctggctctgaggcatggagcaccacagcccacagctgccactgaaactgtggccacttcccaggctcctcgggccaagctcacagtctcaggtgaggggggccagcacgctgtgcccattttaaagacagcttgaggctgacagagggaagccacacagctgaggcagaggagaggggcgttgactacaggctggccctttactcacgagacgggggtaataagcccccacagaggagacagatctgagagggggcctgtggcccccagccacgcagcatgggcaggctgtgggggggtggtctgaggttcacagggcacctggagcctcccctgccagaacggcaaaatctcagctggggacactcagccaggccctctgtggtgaggtgtggcagcaggtaaggagacagtcacaggccctccgtcctgagacccggcccctctgagttgaccagataagggggcagccaggaggcacccaggttcccacagctaacccccgctggaccctgttctggctggggggctccaagcaggtgtcagcagctttccagggctcagatcccccatctgaagtgtgggcttgagacctcctatctcagaggactgtgctgggcttaaggagagaacggtgagcccagaagcctggggaggctccttccccctccaccagggccaagggggtggggcaggcagagggggcgggcccagcccaggctcctccattcatccccataacgtcttgctccagggccctctgcccccacccagcaaatctccagctactcgcccctgccccagcctctccttccgggaaggcagaggtaccagggaggagacagctcaggttacacaggccctcagggcccctagactctccctaaggtggggctgaggtggggaatgggcctagagcggccggttgggagccgttggagctgactttgctgctcctcacccaaggctgaccccaggcccaacctaagtctacagggccccaagagccttggttttcaggtgaggtgtccatgcatggagtccaccaacagaacccgcctacaggtttaaggcttgttggggaggggacatgcaccccagggggtcttcagggcctgaacccacatctcccagggagactgaagcccccggaccctaccacctgctgggcagagatgctgcccctcctgggagccacgtgttcccagccccagtcaaaacttcgcagctggccctcccctactttggaggtctcctcgagtccctagactcctccgagaggggctagtgggagcctcaggtggctggcccctcccaccccatccagaggccaacaggttccagcctgtcccgggtagggcggagctgcgccccctccccaccggcagcaggcggcggaggccaagtcccgccctccccgggatcccggacttggggccgccagggactgggcccggcccccctcccgccccggtcaccgcagtcgaactggaccggcgcccagccgcccccgggtccatgccggggactttaattccgccttcccggagggacgcgaagtttcccggccgagacggagcggccgggtcggggtgccttcttgggcccccaaaatgcggaaccagagagtccgcacctggactcgccccgggccacggcgctccccctggggtcgggccggtgttccgggtccgagtgccccgggaggaagccccacggcccgcccctgcgctcacccggatggtctggttggggtcgccgccggccacggggccccctaccagcttgcagtaaaggtcctcggtggggcgcggggagccgcgcgccggggcctcctctccgcaggtcgcggaggcggcgatgcgggcgccctcggccaggttgaagtagggcgggtgcaggctgaagccgccgcccgcctcctcccgcgcccgcgccgcgcccagcagcgccagcccgaccagcagcagcggcgcggggccccgggggccgcgaacacacagtgcgctccccgcgcagagccgcttcgccatcttcccggctccgggccgcgtccccgagctccagggacagcgcgcgcggcgggagcccggcgggtctgaagccaggcggccggcagggctcgctccgcccgcggacgtcaggccccgccccggcccgcccgagcgcccgagccccgagccccggggagaggtccggggaggcggggtgggggggggaaggagagaggagggggaggggcggccgggcggccttaacccttcggaccccggcccggccgcctcccggaaggggcacctgctggcctcgggccaggccgtgggacgacggcgccgccgggcccccagcccaggtcgtagctccgggtcccgggtgggaccctagcgctccccacgacgccctggcccccagagcgcccaccagctcctcccagcccaggggcccactctttgttcccctaacttgggtgcaccactcggctgcccccgctcctcccccaacagcgtccgtcctgctggctgcgggaaggtgccctctgcacccgcgaatgaccatctgcagaggaacggggcagcctaggtgggaaccccctgcttcctggggcagccaggtcaggttcaactcggcctggctcccgcctgccccagcagggcttaaaaatactctcagatagggaaataggggcaggagggactggcctgcagctgcagccccctttagaggacgggggcggtgctcatggccccacagccgccaaattggctcttaaggaggtcgggggctctggtcacagctgctgagcacctgctgggtgcctggaagcacctgtgctccggggcccggtggactccaccagctctctcggcctggcctccaacccgctgcacagccgcgcacgcgttcctgccacgatcggcggctcgaggacgcctggcaaacagcacaggacctagaggccgagatcaggtcttcgtctgcctttgggtggctgcggccctgggtctcctacttcccttgggctccggggccaaatctgcctccagggaagccccgagggggtggcggcggggtggggctgcagctgccgagctggcagcaaacccccatccctgagccaggccagctgggcgggccatggtcccagatgggctgtggggctcatctctcgctgggttccctggacagtcccggggggctgggtgggtttgtggggcactggccagccggttctggtgggggttctgagctagcagctgtccctggagggtgcacctccttgcacaccttcctggcgccctggcctcctgcaaatctcaaatcccaagagggtgtatggccctttctctacggagtcgggagggcgatgggaccctctctccctcctcctactttccggcccggcaattcttccataacttcactattagttctcccacctgggggaggggggagaggaggcggctccccttggcaggagaagctccaagtgggggaggggctggctggagagggggcggagacatcaaggaatctgcagtccaggcgcagagtccggctctgagctgctttagatcccgtgtgaggcagagagtggcctctgggcagtagcgggtccccaggtgggggcttggccccaggcagtgtgctctggctctgggctcccccttgacagcttggggctctgacagcctgggggactggaggtggagactcctgagaccctgagggcttcttgggatccctggagggtcgggtggttggaggggtgggattgcgagtggcggggcagggggagaggtgggggtggggagagcactttaagcctcctagcggccagatcaggccaagctgccaggcctccgctgtcccccggcactggccaggaggggagcgggggccggccctgagaatgcgctgtgtcagccggagctgccagcaccagcagggttaatcaccgggctcactgcttcccggcagacagctgccccgggagcaactggcaggcaggcgggcagcgcagtggacaagagaatgtggcccaggggctgggtaaagagcccacactctgcccccaccctgtgtctgctggtgcacggactgggaaggaggcagctggggcaggagctgagcgtatggagggcgggggggctgtcccagccgggctacacacagggggttggggaggtgagcagggagaggggcagctcatctctgcacacccccacccctgctgtctttgtcatggttccagtgagtcatcaccaaatggaccagcgagcctgtctccttgtctttctgagtcctgcgcagcccagccacctcttctatttacaaatggggaaactgaggccaaaaaggccagggtcaatcaagagcacacaagttagtaaagcaagaggaagtttgtccatcattcatttcttactcctatttactgggcatctttcgggcacccgcccgtgacgtagtcctcctccctgcaacaggtcagacggcaccccacccccaaacacgtcctgtcctgaatccacaggagggagctgcccagtctgggagtggaggggagggtaaaaggaggtggctcgccaggggagggccgtggaggagcctctgtcccaccaggctctggctgccctccagggacaatccaagatccagagcccctgcccacccagctccagggtgatggagccccagaggaggtgggtcgggggcaggggtcagtggcagcccgagagaagtaggggcactcctggccctggggaaggggtctcagatcctcccccagccctgggacaaggtctgctgcggagccctgggggcagccacctcacctgagcccccagtgctactccagtggcattcctgagaatgcccccaccctactcggccacacctgcaggcagctgtgggggaccctgagggtaggccacaggcacatctgactcagccgtgagtcgtgaactcctgaccttgggagcctcctggggacaccgctgtgctgaggacatggggcacccccacgcccacactcagctgcatcacaggcagccacaatcagtaacagatgactctgcagaccctcctgtcccagagcccagggtccaagtgggtgctgtaccctcgggagaagcccccaagaggaagcgggggctgagcaagaaggagggctggaggctgggctcctgctagggccgggcctgcgggtgaggccttgtggctcccactccagaactgggaatgttgtctcagcgggatgaggtctggaggaacgccagcgctgtggtttgggatatcggaggccacagtccctttctcagggctgctgggatgcccttccgtggagccggctggtaagaacctccatccctgtccatgaaatagagaagctgggagcgggcagcaaggctggttctgaactgttcgcgtgggccagctcagtcctctgggaggaggacacagaacagcaggtgccgggaagacaaggtctcatcaggattgcataaacccagcggactgggagagcttctgggcctcttggcctaggaggcccccactgccctcagcctggacagactgctgtaagagccagcccggagttgcagaccctggggggctggcctcaaaggaatggaggcagagcccaggaagaccctgagccatagccagacccctcccccaggcctggagcccgccttcccccagggctgccacctgcctccagcctccgagggtctgcaggttcctgctgccagaaggatggggccaagggatagtccggccttcctggcctaggcagggtctggaaacagcccgtttggaaggagtggtgctttttcctccctggctgtgaccccagctgggccactgctgggctcctgacggcctctgggacatgtggttgttggaaagcacagagaccaggctccgggttgacactaaccaggaatgaaggactctgacccaccgctgcctggcccctggcccctctgccacttgctgtgtgtgcccagctcacaggccacgcagccccaggcaccactcacggggcaggccctccacagacttggggctcttcaaagccttccaggccaggcaccatgccaggagcatggccaccgccttagggctccaggagacaagtcacccgtgcaggtgacatgcctcacgcctgcccactccccgaggcccgacccaaaggctgccactgggttcacacctggggggtttcaggtgggcccccatgccagagggggtgcagacaggcttaggtggtgcccagtgtcggagatctggagagggtcagcatccgggctccttgggctctccacagatgctccccgaggctcctcttgcccacccagctccttttcttcccaagtggcaaggagaagcgcttgggctggtgccctgtgcaggcgggcccagccccatgacaagcaggcaaacctggggtgctcagaaatgggggggcctcatggagctctgtggggtggtctgcgtggcgaccgaaagtccagagtccaggatcccacctggatgcccctgccccggcctgggcctgtgtagctgggtgtaggggagcctccaccctgccagcctttaggagggaaggagtagggggccctgggaactcccagggagggggcccgggacctccctgggatctaaccacctacaacttggcagggaaggggccggtccagtaacaaggttgctcccaggaccccaacccatcccctccctcaagtgggggcccctgtcagggcacctcccagcaccttgctggggtgtgaggcagagtccaggactcctgcccccagatctctggggagccccagaaaaggcatcgcccggggtaaacatgcagtggcacacggctgcagcgtccaccccgaggccgggcacctacgcttccacgtgtcaccttaatcttatttaattgcggtccccctaccccgtacccccattcttaccacttgcttgcctcaggcctagactggggagccctagtgagctccaggggccaggaaccccaggggaaacaggcggaatgggggcgccccagcatgctgggcagggtgactcgggaccctgagcctctacccctggggcctggcctgcctgtgccctcctcccccacaggaccacggctccagcaggccctcccctgcctctgtccttgcctggctgagctctggttctcatagagggtggggcgggtggggggtgagggttctgagcttctccaggaggtgcccacagacggccttatatggccagaaggcctcgaagcccaggaggaatctgacttcccaggagggcccagtgggcagagccagagcctgggcaggaacctgggactgcgccctgggcgaggccagggcccccacgagcccaccctcaaatgtctcccatgaacccagcctcctgggctgagaacccctcagagggaggcagcttggcccggcccctcaccgaccttgggacatctggctgggggtcccacatggatgggaacacctgcagctctgcaaaggcccctcctcaggacaaaggcctcccctcatccgggttggctttcccgcactgcaagggcaactccccaggccccacagtcagccgcttccagcctcatggacgcccacggggcttcatcccctctgcctgcgccctggtgtgtgccttggctagccagggtccctggggcagagggaagcgtccccctcccacccctccctctcctgactctctccctctgactctctgcctctctgtctccatctgtctgtctctgtttctgtctctatctctgtatctctttctctgtctgtttctgtcttcaactctctgtctctatttctctgtctctatctctttgtctatctctctgtttctccgtttctgcttgtctccatctctctctctatttctgtctctgtctctatctctttgtctatctctgtttctccgtttctgcttgtctccatctctatttctgtctctgtctctatctctttgtctatctctgtttctccgtttctgcttgtctccatctgtctcgatctctgtctctttgtctctgtttctctctgtctctgtatctctctgtctttgtgtctctctatctctctttgtctctcttgctctctttgtgttccccccgctgctgccctagccctgccaagctcagccaagggtcttagggatcacaggtgtgagcctcggtcacgttcactagggatcgcgggtgtgggcctcggtcacgttcactagggatcgcgggtgtgcgcctcggtcacgttcactagggatcgcgggtgtgcgcctcggtcacgttcactagggatcgcgggtgtgggcctcggtcacgttcactagggatcgcgggtgtgcgcctcggtcacgttcactagggatcgcgggtgtgggcctcggtcacgttcactagggatcgcgggtgtgcgcctcggtcacgttcactagggatcgcgggtgtgggcctcggtcacgttcactagggatcgcgggtgtgcgcctcggtcacgttcactagggatcgcgggtgtgcgcctcggtcacgttcactagggatcgcgggtgtgcgcctcggtcactttatttgactggatcgaacgtggggcttggcttagtctgggggctggtgccatcactgggacacaacgggccacggttcctgcccaggagctggtccagattctgcagtgaaccaggatcccaggagtgacggctcccaggccgcgcacttccacactgaaagtgccatccacaacagggatgggccctctgtccttgcgccctctgcccgggaggcatgttgctgcccccggctcacagaggacagtgcagcgtgtccttgggcgtccaggatgagatctcctgacccacatcagccccccagacaaagcacataaggcagaggcagctccgtgtgctcactgctgcgtccgagcccagcgctgggctgctggacgatggtggctgaatgaccgatcgcccctctcccgtcaccttcccactgccccgggacccacatcctcccacaccaggcgtggcaggcaagggcccagtgcccagactccagcctctttttatgcccgcctgaggcccacaccgtgatcctcactctatagccaccaacagaatcaggaaataagacaataacaactacaggcaggatcctgcggggaccagtgtggtgtccagtgtgggagctgctaggacaccagctggtggttcctcaaaggactgaacacagttgcacacggcccagcagctccacacctggtagctgcagagagaagcgtaaacacgtctctgcacagacactcgtgggtaaacacgcacggcagcgccaggcaccagagccatcaggcagaaacagcccgaacggccatccagggtcgactggggagagaaacgtggtccatccacacagtagacatcagtggacaggagcggcactctgtacaggcaggctcttggaggggctgcccagggaccagggaccggaggcctgggatgtgccatggccactggcccctcgccagtgtggagggggagagggaggagcacgtggatgctgagtgagcctgcagagccagttcaggcgggcaggtgcctgggagtcttcaggtggaggtcagtagaagcagggtacttcttggtgcttatgggccacccacacagcctgccaacaccagctggacctgtgctcatgcacagagaggtgggggcctgtgtttagggccatcacatacccaggacacccagccctacacactgactcagcctggggcgggagagacagccccgcagctgcctctgtcttcagcccggtctgccaggagcctgagttactaggcaggtccagggcctgacccccgtcccctagggtcttcattgattcaaaccgccaagcaacacctcagccacctccacctattgccagcccagtttcacgaaaggaaggctgaaaggtgggaggatggcagtgccactgaatcccctgggctggctgccccagctccggcaggaagatgccccagctgggcccccatgtgcctgtcccctgccaggagggggagggggagggggtgggccaggtgaggaggtaaccccaggatcccactgggcccccgatgtgtggaggggcaaagtgtgggtgggcccactccaggcctctgtttgccacaagttccaacattaagaaaatatttgcagctcttctggggagctatttcctgggggaatgtaaacacacggagacttggaaggctcccgctgaccacagatggtgctggggtccactgggggcccacgtttcctctcgcaagggatctggaccacccccggcagccaggtcaggggtctgtgcgtggcctcccatggggctctctctcagaacccgggagtggcagtggggatggcgtgcaagagagcagctgccacggagcctcctggcggccagggtagggcctgtcggcccagttgcccactgcctgctcctggctccacaaagggcttgctgggcagcttcaggtcagaggcgcagcccccacctccagccccctgaacatgtgggggttgtgttttcttgacctgggcccccccgtgcctccctcccacctctgtgcaggagagccaggcagcccgtgcagccgacatcaggccgggcgcggagctggctcccatctcctgcgagggacctgctcttgtttttttttgttttttgagatggagttttgctcgtcgcccaggctggagtgcagtggcgcgatctcggctcactgtaacctctgcatctcgggttcaagcgattctcctgcctcagcttcctgagtagctgggattacaggtgctcgccaccacgcccagctaatttttgtatttttagtagagacaaggtttcactatgttggccaggctggtctcgaattcctgacctcaagtgatccacaggcctcatcctctcaaagtgctgggattacaggtgtgagccaccgcctggcccccttgttatctgtattttacagatggggaggcttggttgcaggtgaagtgtggccatgtcctgccagccccccggagctggtgaatccctgccttatctgcaagtggcttctccccacacagaaaggcgaaaggcgacctccgcctgagtgttccagcaaaggccgactggctcagctccaatatgctgagctcggcagagcctggacagggctccccaggccccgcaggaggctggcgcaggccgcaggctggcctccctatctccaccaggaatgcactgagcccctgcacccctgcccacccaggtggaggaatgtggcaggggctgctgggaactcggagcctggaggagggcttttgaggcctctgcctcctggaattccccaggcctggcaccaggcggctgctccctcaggatccgcctgcctcggcctgcccccaggcggccgtgctctcagattctcctcttcccaggctgtggggacctgcagaggaaccgggccatctcaattccgctcactctgtgaaagtcccctgctcagagaggccttccctggccaccctgcccctggagccccttcatccgggccatggcccttcagagcccctcaacaggcgctggtcagacagtctggctggacactgacctgaggtggggccgcttggcccccactcccaagaggccagaagcacttgccctccagtcgtgacaaccaaaaatatcttctgagtagccccatgtcccggggctgaatctccccggtgagactcacagccctacaccctcctgggatgccagttgtcccgtcctaggctgcgagctccctgggcacagggctgtctgttccacgcaccaaggagcgcctgtacccagcacggggcttggaaatggcgggtggacatgacgggtgttctgtgctctacggttcccggcttctgatttgcaattgttcggtagaaaccgtacttccagtgcccacacaaccaatctgtttttctccttcttatagcattggacaaattacgtgaggcatttgatgcattattataaaggaggcttcgt

SEQ ID NO: 1127 - DNA, 50769 bp, Homo sapiens
cctccgcagcgaaaccgtcacccagcttgcatttctcaccttggtcaaaggctttcctgataacttgtggccctcctggggagcctcgcatcacccagatccctccctctccctttcccccaatgtccaggccatcaatcctcaattctttagaccagggagctaattaatggggctgagagactgtagaaaaataaccaagagtgcagaggaaacacataccgcatattcctcacattttaccaagttcgtgttttaaaaaaaatgacccatggcacaatttaatttcttcatttctaaaaatcctgagtgaaggacacaaagaagcagagagaagtggttttgcagccttgattggaacaagcactcccttgagctgccatgaggcagggacgacaaatgaaggcctctaaaacagcccggggggtctccgtgtctaagaaggaggcagcttccagggaagctgctgacagattcgcagatgttggcagctgtggatgtgtagatccgggcagcgaaacactgagtgacccccactggccctgcctttctccttcctaagaggcaggctcccaaaatgtccttcttaaaactccagtagctccacactcacaaacaaggggtgcatcttcaactggtgacaacattctcatctctccctagaacttcctgctgttcggtgcagacgttgtctataaatgaaggcaccaggggtgccgggggctgtcagccacacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtggattctgtgtgctggtattgtttcttgttttatgttcatttatttattattcattggctgtaaccaatgtggccggcagtgccagtttacagcacagatacaatcatctctttttatttctataattaatctctggaatccccacagcctccattaacagaaagtctcattgttccaaatgtccttgtgattttcttagtccaaattcctaatgtcacacagagagggtctggagagtgggtcagtccactatgctgttgttctttccactaccacatggtgtggctgttgacccgtcattctgcacagcccattgtcctgtgtagtcacctgtccactaggactgttgctcccgtcactaccacacggtgtcgctgttgaaaagctagcctgcacagcccaccttccctgccccacacttgggctccccgtttcatccatgttctcctgcccagccattgtccccaaaagcagaacaatgggccaggtgacagagtccattggggttttctgcttcagtcacatctttgggtgcaattagcacttccccatgactctcccagctctagtgtggaagccagatcaccaacccagactgtctttggaattctggggagtttccttgggggctttgggccatttcctgccatgggacatcagagggggctatctcagcccatgagatggggttttatggattgtacttcagattgattgaggagtcctggaaggcctttctacactgctgacatgtgctctgagaccataaggatgagcaacaacacactggaggagttcgatgcagacggtggagtgggggaccacatgaccagatttagtttttaaaatgttttattgtgacttctgaaagcatcagaaggacaagagggcaagggatgagcacaaattaggaatgtgttgttattcaagcttcaaccagattggtgatggtaaaattgaagagaagcatttgtagcgagcaaaagcagataaaaggtatttattttatttataaagaaaaatgtacacacttctgctgacatcattgattctctgtcaaatggagttaaaggctctagggccacacaagaagggagggccattgatcaaacactctcaggagtcaagcaaagggcatgaatgatctaatttaatcctgatagcattcttcatcccccaagatggcaattgctcaaacttttttggttgtttgtttttgagacagagtcttgctctgtcacccaggctggagtgcagtggcacgatctcagctcactgcaacctctgactcccaagttcaagcgattctcctgcctcagcctcctgagtagctgggactacaggcatgtgccatcatgcctggctaatttttgtatttttagtagagatgaggtttcatcatgttggccgggcaggtctcaaactcctgacctcaggtcatctacctgcctgggtctcccaaagcgctgggattacaggggtgagccaccgagcccagctgttcaaacattttaaattgagttacccttccctgatcacatagccagcaggtggcagagttggaattcccaccttatctattcccacatgtcagagcccatgctttttttgctcctccccgatgtcaaaatgttgtctgttctgggggacttggcacgtttaaagcagaacttctttgttctgtggcataggttgtacactgtaaaacataggttgtaccaggttgaggaaacaaaagtctttctctaatttgtccaccagtagtatgcatctttttctccactagccaggggctatggaggccctgaatagaacagaagagcagctagcaagggcggaaggaagagagagaagggaagcacagcgtgggatagactgggaggccatgaggactgttaagggctctaggttttgttccaaaagataaggcaagccactggagagttttgagcagaagaatgttacaatccaattcacatttgtaaaagagccctctggctgctggggagactagctggtagatatggacacacacctgccatcccccaccctcattctctttggagttaacccccttctacacctgccctctactttctgtaacatataggcaccccctgctccacactctatagaaaaaaaaaaaaaaatgcaattattaggttggtgcaaaagtaattgcggtttttgccattacttttaatgcaaaaaccgcaattactttttttttttggagacagagtctcgctctgtcacccaggctggaatgcagtggtgtgatcttggctcactgcaacctctgcctcccggattcaaaccgttctcctgcctcagcctcccaagtatctgggattacagtctcacaccagtacgcgcggctaatattttgtgtacatatatttttaaatatagacagggtttctccatgttggccagagtggtctccaactcctgacctcaagtgatccacccaccttggccttccaaagtgctgggattacaagtgtgagccactgaatccagtcttggccgttacttttaatgccaaaaaaaataattacttttccatcaacctaaatctttcttggacctgaagattggtgcatgaaacacattgtgcctgcgaacttctctctaatggctgaggaaaggcagttgcttgggggttagggtttgagcagcattccccaacacactccaaaggttctgccaagttggctacagaaccactatttgagcagcttctcccttcaggctaagcattgtctgctgcagatgactgcaaatgtgtgtttggggtttctttgggtgacgttgaaaatgttctaaaattaaattctggattgtacactttaaatgggtgaattttatgtatatgaaatatatgtcaataaagtggcaaaagacaattgaagaagaaaaaaaagaattgttcactccaaactgcctaaaagctcaccatcagagcagcttcccttctgggataagcacagccttcctggggttccttttggaaatgctgacttattaaataaatatgagggaggagtaccctctgcaaggagagaaggtggggaggggcacaggaagactaagcactgtcttcatcattttgccatgtcccgctagtggccatgagcagccctgtccctgggtctatctcttcaggcttatgatcctatttaatcctcatgacaaccgctaaaggtagccaaggttgcccttgtttttcagatgaggagtctctagaaaagtcgtgtggcctgctaagctaactgttcagagcctgggctctggagtcacctggcggtggtttcaaacataaatccggccccctcaagagctgtgtgactttgcaaatgttccttaacctctctggccctctatttcctcctttgaaaaggagagttaaaatcttgccctctcggcatgaggttattgggaagaatcagaggtatgattgatagggtcatggcacagtggttaagagtatgaaccatgatcccagatatcttgggtttaaatcccacgtctgctatttaccagctgtgtgactttgggcagtatacttaattctcaggttttctatttctcatctataaagggaacatcattatagtacctacctcataaagttgttatgagaatcaaatacatgtcaaatccgtggtacaggggttgacaacagtaatccaagtttgctctaatttgaataaacgcagttcttcttactatactgtaaagactatatctgaccaggtgcagtggctcacgacctgtaatcccagcactttggaagtctgaggcaggtggatcacttgaacccaggagttcgagaccagcctgggcaacatggcgaaacccagtctccactaaaaacacaaaaattagccgggcgtggtggcacacacctgtagtcccagctactcaggaggctgacgcacgagtatcatttgaacccagaaggcggaggttgcagtgtgctgagatcacaccactgcactccatccagcctgggtgatggagtgagactctgtctcaaaaaaaaaaaaacaaaaaaaatactatatctggctacagtagtattcccaatgcctgccacatagttggtgatcagtaagtatttattttaaaaatgatctgggatttcaacccacatctgcataactcaaaacatttatgccagtgattctcaatgtatgatccagggctgtctgcctgaatgggcctgaccccaagaatcagagcccctggctggccacaactctggatttatcctctccagttcagcaataggctcacagtgtaacctgggccagttctccctctctaggtctcagtttccccatctgtaaaagtaagggctctctggggtgaggagctgtttatccacatgaccagccctgctccatgggggctcctggtatctcaagacacgcaaccttcaagccacaaaggatcgtcactgacgttactacttttattttgtaagcccgcatgtctcagggctcatgtgtgtgtgtctgtgcgtgtgcgtacacaggcacacgttcagatctgcaggtgatgtggcttggggagaggctgccataaatattaaactcccaactccaaagtaccctgcagagattcagaactgaaggaattcataacatcattctctttcaagagtcagtgttctcaggagtgtgggcaccgtcatagaaaactatcgaaaaggagagtgaagcgttagagaactgctgagcttggagggaactcggagctcatttagtcccttgttcccgaagctccaagcacaatccgtggtcagcagcatcaccctcaccagggagcttgttaaaatgcagaggctcagccccaagaggaacatgatggatcaagatttgcatctaaacaagatccctgggggacttgcctgcacgtctttgtttctgaaaagctgtcctagtccccagccctcatctgcatttgggggaaacatgaggaacagagaggggtggagtttgttccaggtcccccagcccattaggagcagggccttgacaaaaaacctgtacagactttggaaaaggattcaaagctctctgcgagaggcaggcgtttgcacaaaagatgaataagtgcagaagaaatgctcagtgttgctaattgtgtccaacagggttcaggcaagaaaagagaatccaactgcattggttcttgggatttgattaaagtggctatttctagagttgggggacaagcttgaggaaaccaaccagggactgtttttcctaaggctcaagcagcaaagaaaagcatctgggtatcccagcccaaggagataataggagccaaggacaaggccttatcaggagggacacagccaactgccacacttgtgatctagagaagacagcagggaaaagtgccctgacatctgacctcctgccatgccaccctctggctgaacccaagtagagatgaggaaactgagtcacaaagtgcccaaagtcaccccgtgggggagtcaggattcaaatccaggccatctggccccagagtccataaagataaacataaggtttgtttattcctttggcaattatctactatttgctgctcagtattctagacactatggattccaaattctgggtttttcaaaatcttttcagtaacacttttgtagtgagaatattatcggtggcgagtccgcaacactcccagcccttgtcttctcagaggaaagaattcaattgagagacgcaggcaagttttaaagcagaggcaaaggtttattgaaagaagcaaagtacaattgagagatcaagtgccccgctcaacctttggctcggggcttttatacactggcttggttctggggtttcttctcctccttgattcctcccttcggtgggctgctgcgccctccctgcatgcgcaatggcctgccagcacttgggaggggccgcatgcgcagtgtgtttactaaggttgtgcgcatgctcacttggggtgattttcccttactggtccgtcgccgcaagaaaaaggtcatatacaagtcagactccaacatttgcccttctgctcgaccttaccagggaattgtggtttgctggctccagatgatgtcaactatctgttagggaactcctctccctcttggcgccattcgtggccacttatcatgtcagagggacagttttatgatcgcctgtccatcatttgatgcactgccatttctgggggccctctcctgcacaagaacacaataaacagccttgttaaaagagtccctatttcactgcaataagactgagtggtggccagagtggtagcagctgttgcttttgtggaattggatggacagcctggtaggagaaaggcccaggggttctgaccagcagtggggtcgtgctgctccctgaggcctctgctgggtcctgggccatcagcagggaccttagccagcagtgggcacctgcaggggtggaggccaggcctgggccatgtggcagctctaaggtccaaagattgctgctgtgggaaattcccacccctgcaaatgactcccagccagggacatccttaaactgctgccagaggaagagtgacatctatgtccccataagatccttatgctccagaatgtcctcccccactctcctcccctcctgggcaggctgaggtccaggaagcaaaggcccctaggcacactggggatgcacctgtgagccctttcctgctccaaagcctcccaaaggctggctccttaccctgaggcctctgctcagcttgttgcctcccaagagaaccctgccctgaccagagttttggaatggcatcctgcagacctggacttaaattcctgctgggtgactgcagcctacatcacttcaccctgccaaacctcagtttcttcatctcaagacaagactaaaatatccacctggggttgctgatgcaaggatgagaggagacgtgcagcttaaccagcacagcgcctgcacatagtaggtgctcaataaatatcagtttctttccaattcctgctgggtgctgcaaggatctcaggaaatggaagactcagccgtgcctgcaaggagccatcagactggtggtgtggggactgaggggagggacggatgaggatcccaacaaacctcagccccagtgacaggagcaacacggtacagaggagcagagaggcctggactgtggggttccctgtgcttaacgtgggacattctgatcttaacctcagtgcctgccagtgctgtttgtgacctattgggagtcaccctgttaatcccaccacattcagttggttgaggccatcatgaaaacctgcccaatttcaagggaagggggcagaaacattaccttttgatggaaggaatatcaaagaattcgtgggcatatttttaaaggaccacaattatcaaaaagcagagtggttaatgctgtggtggggaaagcgcaaagggttctgggacctcagaggggaccctttctagaatccagagaagcatgggagtggtcagggaaggcttcctgggggtgagggcaaagcagaactcacaaatgtaagcagggctggggcaaaactctaaaaattaaacacagtctgtactataaattttgttttccagaatgaaattttactatctttacttactgcgaatatatgcccgggaccatacccccaagaaaataaaaattttagaggctgggcatggtggcccaagtctataatcccagtattttggaaggccaagcgggaggcttacttgagctcaggagttcgacaccagcctgggcaacatagcaagacctcgtccctactaaaatacaaaaaattagctggacatggtggctcacacctgtagtcccagctacttagggggctgtggtgggaggatcacttgagcccaggaagttgaggttgcagcgagcgatgttcatgccactggactcctgcttgagcaacagagtagactttgtctcaaaaaatgaaaaaagaaaaaaaaattgtacgtatcaacaagcaaaaacttttttaacacttataattctacccccacaaccagagacaatgcctcatgactccttgctaaatattttccagattgttgaacatagaagcctattttgaaccccccaaaatagaaccttactctatggtgccattggaaacggatgcctcatgacatccctttccttgccaagaaatacctttatttctgcagcctcactttaagggacatgtcataattcatttaaccaatgcccttctggtggatacatgaggttgggtctcacttctcctgtcctgtttcccacagcatagcagtggtatcttggagcagtgatttactggcacactgactcaattatgtatttaagggcaagtccctgaaattgaattcctgggtcacagggcatgcaactgtttaaacatttgccaattgccttccagaaaatttcaccaccagcaaggtttgagaaacactgttttcccattgggggaaacatttattttttaaataaacgagccaatatattttaaaaaagagagtttggttggtgccagatgtagcttcactctcaaccctgccgtctgctgggggtgagatctcaagggagctatgtggcttttttgaacctcagtttcctcatctgctaaaccaggccttcctagccgagctcttaagagactggctgagatgaggcaagatgaacagtgatgaatatggggtctttctgtggggagggtggacagggatgatcataggagtcaggcttcctcatccactgatctaggcagtgaaaactggcttctaagtatgaccttatgacttcagtgatgtcgcaagcaggttccagtccctgtgcctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatggtaagaagccacatctgctggctggacttggcaaacccacgctccaggctgctctgggtacagtggggacagggagtggggacacagaccggaccctctccctggggcagtgccaccttctgggtcaggtggctctggctcctattctggccttactgcccaccagctgagtgccctgggcatgttatttgtggtagtgaggtcctccaccagccaacagaacacagctttgcgtgcaagtagttgatttgggaaatgattccaggaaacactgtagggaatcggtactgagatgaggaagggagggcagccaggagagagtgtgcaattaaaccagccaccacctctgatgatgggaaccactcagctgggaaaattctgcgtaaagtttggaaacacatgcctctgaactggaagtcagaattgtggtcacctctagaggcaggcagagaccctgaagggcatgagggaggtctgccggggtgctggaagttgccatatcttgatccaggtggtgatcacattcctgtataaacattaaaaattatttagcaatacctttaaaatttgtgcccgttaggtactttatgtatattattcctcaattttaaagaatgggcaggccaggcacagtggctcacgcctgtaatcccagcactttgggaggccgaggtgggtggatagcttcaggccaggagttcgaggcaagcctggccaacatggtgaagcctcgcctctcctaaaaatacaaaaattagccagtcttggtggcagccaactgtaatcccagctacttgggaggctgaggcaggagaatcgcttgaacccgggaggcagaggttgcagtgagccgagatcatgctgctgcattgcagcctgggcaacagagggagactgtctcaaaaaaataaataaaaataaaacaaagaatgagcaaaagtaggagtatttttttttaaatactgaaacaaagcctcccgactatccaggtggcatgggaactgggatatttatacaccacagtgattgattgagggcttctgggccgggggtttgtcaactccccagcacttctgtcctgttgcatgtacctgctttctgcagttccaggacaaaaagcctcgggacatacaggctcagggaggcagacattggcagctgggagtcaactgtcactcactggaaagactcaaggatatggacaggcactgaccacatgtcttctcacatccctagagcctcaattgccttacctattaaatgagataacaacattcccttagatagggttgttgggagcccagactggctcgagacaggcagagggaaatcagggaaggattccaggatatagtaaaatggaaaagacagtgggaattacccagggacaaggggtagcgttccaggcggaaggaccccaacatgtgcgtttgctagagggagaagagcaaattggaaagaggtgaaaggggaggctgctggtcatctgtgtacccatgtctgccttggggacagaaacctgggcccctcagatctcggaacagtgggacctggtaactgctacttgcattgaaactgtaaatcagggaagtttctcttttgttcctttgcactgtgcacacacaccatgtttatgtaaccagtcctctgaggttggacattttggtcctttccatattttttttttttttgaaacggagtctcactctgttgccaggctggagtgcaatggcacaatctcagctcactgcaacctccgactccctggttcaagtgattctcctgcctcagcctcccgagtagctgggattacaggcacatgctaccacgcccagctaatttttgtatttttagtagagacagggtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagttttgttttgttttgttttgttttgtttgagacagagtctgactctgtcgcccaggctagagtgcggtagtgcgatctcggctcactgcaatctctgcctcccgggttcaagtgattctcctgcctcagcctcctgagtagctgagactacaggtgcctgccaccatgcccggctaatttttgtattttttagcagagatgaagtttcaccatattggccaggctggtctcgaactcctgacctcaggtgatctgccctcctcggcctcccaaagtgctgggattacaggcgtgagccaccacgcccagcaaatgtattgttgtcattgctatttgacagatgaacaaagtgaaggttgtttggggactttgtcaaagtcacccagctagaaagatgccctctttctctagcccccagatccttccagtttcttctacacaggccagatgtcatggagaacaagaaggaggactatccgtccaagcgcacagcacttttgcccttggggatttgttggcaaaggcattccatttcctcatcagtaaaatgggcatgaacctaacaatgccacagaaatgcagggacacctctgaatgtccctcatgctacctggcacacagaggggctcatatcctgtcattgtacttaatgctaataaggatgttggcccctctcttgaggacaggtgggagccaccgtagggtttagagcaggggaggaggcaggcagatcaagctgactcccagctatttcctttccacagcggcccaggaggggctattggctctgcagagtgagctgctcaggatcacgctgcctgacttcaccggggacttgaggatcccccacgtcggccgtgggcgctatgagttccacaggtggggctctcccttctgctgcggctctgaagtggctggagctggctgtcagggggaattggagagtgaggaagagagagcctcaggattgggctgtggggggacctctccggggcggacagtgggatagttccctgaagagctcagaaggaaattctgggaaggaattgagctcctccactcagtcacgcagcaaatattaaggaagacctactggctgtgtgatctgagccttgatttccttatctgtaaaatggagttgatctacttcctccttcagagtgctcatccaagatccaatctggccactagatatagtttggaagagaagatagaccttacactttaaatgtagtagcccaacggttagagctgaagtttgtacttgggggagtcagggaaggcttccaggagaaggtggcatttgagccaagtcttcaaaagtttactagacttgagcagctgatgctttaaaagagcgtgaactgctttttgagggatgggcagtgaagaaacgacaatcagactcgtagcacattgtacccctccctgctcactgctgttgggcgtttccttcattcctgccttcttttattcagtccatcagcaaaaatctattgggcacctactatgtgcccggcaaataaaatagaacttgaccgttcttttcccactgtgacaaccttgctgacttttttggggtcttatcttaaggctgccaccatcttccctgaatctgtttcccccctacctggatgtattgagagagaggagggttagcaggaactgcaaacccaaagggatatgtctacggaccttctcaggatgccaccgggggtcattagattcatgggttctgatgcagactgcaaaaccgtgagcaattgcatcccttcctcaaggttctatttccccctttgtggaaagggagcaagaacactgctgaccccttcagtgtggcccatatggcatgaagaaagtaacgtgcttagcatggtcataagatcgatgcctggggcacagcaggtgcttacctggagcagatcctgctggtctagtccccactgtggagaggggaggcgcaaggtccctggtgaggctgggtccaggcccagggctgacacctccttccatgtctctcccttcagcctgaacatccacagctgtgagctgcttcactctgcgctgaggcctgtccctggccagggcctgagtctcagcatctccgactcctccatccgggtccagggcaggtggaaggtgcgcaagtcattcttgtaagttggctctgctcccaggccctggagctcttggccttggccttcgccccatccttcttaggtccaaggtgttcctagcttatcagaaaggccacgtgatggacagatggagtccaagcccggaggtggcctggggattgagtcctggctcttggatgagtgtctttctgtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagtggagaacacgcctctgagttactccagccccacgctgtcaccccgtcctcctgcttgccattggccaagggctgcttccaggggctctggctctcaggcactttgaacagttctctgacctcagaggcacttggatggaaggggtattcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccctttggcaatttcctcacgtggtctttcctctgtgctcaagaaatcccatttctgaggccatgcacgttggctcacccctgtaatcccagcactttgggaggctgaggcgggaagatcacttgaggtcaggagttcaagaccagcctggccaacatggcaaaaatcagtctctactaaaaatgaaaaataaattaaaaatttaaaaattagccaggtgtggtggcaggtacctgtaatctcaactactcaggaggctagacagaagaatcgtttgaaccctggaggcagaggttgcacagagctgagatcatgccactgtactccagcctgggggacagagcgagactccatctctaaaaaaaaaaaaaaagaaaaaagaaaggaaagaaaccccgtttctctctgtatgtcctaatctctttttataaagacactagtcacattggattagggcccaccctaatggcctcatttaaatgtaatcacctcttcaaagggcctatctccaatactgtgacattctcaggtactggggatcagagcttcaacatctgaatttgggaggcaggtggtgacacagagcagcccatagcagaaggaacagcccaaatatgggtgatatgaccatatttatacttcagacctgcactgcctaaaatagaagccaccagccatgcctttactgagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaccgctgtagcctgggaggcggaggttgcggtgagccaagatcacgccactgcactccagtctgggcaagagagtgagaccctatctcaaaataattaattcattagttaattaaataaaataaattagccaccacacctggctaatttttaaaattatttattataaataaataaatctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttaccctggcttttgtcactgaagtatcttaaatatctctttctatgggcatatgactatctacctcattttttttcacttttttgaatgtgcttttaaaaattgataggaaattcacggaacataaaattgattatttgaaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtatgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagggaaataagctcatatattaaggaaattggctctttagatgtctcatactgcaattttttttttactttacatatggcattttttttgtccactgaagttttaattttctatgccgacaagtttatcaaggatttcctttatggcttatgagacttggatattgcctagaaaggccttcatccagccctgcctggaaatactggatctgggctttcttctagatcttttatggctttatttgttattcttaaatctctgctcagctccatgtatttggaggtcagaactgagccttctattttccccacaaatggtggcagacccctggtctaggaactaaccatggcttctcttacctcctccagcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtaggtctccatcggggcactgccagctggactcctggttgcagctcccggccaatccagcgctcagcctggcctccgataattgcaatgatccaggtggcttgcacaggcacttgaagatcattctctggggaaccctgttgagatgaacagacttaagccaggaatattggtgcatcattttcattaaaaaaataaactttcattcacctgacaaggggacccttgtcaggtgaatgaaatctggctatttggaggaacacagaaactttggttgaaggagagtttgcgaaaaacatacaagtccttggacaagtcatttcatctcttctagtctcagtttccttgattagaaaagtgtgaccgggtgtggtggctcacgcctgtaatcctaacaatttgagacgccaaggcagaaaatcgcttgagctcaggagttcaagaccagcctgggcaacgtggtaaaacctgtctccacaaaaaaatacaaaaattagccaggcatgatggcacatgcctgtagtctcagctacttcaggggctgagttgggaggatggcttcaggccaggcgacagaggttgcagtgagctgagattgtgccactgcactccagcctgggtgacaaggtgagatcctgtcccccacccccccgcaaaagaaaagaaaaatgtggattctcaagccgcttccccaaatctgctgaatgtgatcatgcgattgggtgccgcaggcactgggaagccagacacaccgaatcaggctggatgtgctgggacacagcagggcgccgggaaggggtggagagggctccctttgtggactggcctgaccagggaccagggcctggctttcccaggcacccggccatccccaagttcagtggcagactgtgcttctctccccaggtggctgttgaacctcttccacaaccagattgagtccaagttccagaaagtactggagagcagggtaagaaggtccaagcctctggcctcccccgagcttggcgagggctgaatggaagacctcactgaccaatggccctggaccaggccatgggggctggtttagacgtacttgggcccaaagcccagggaggacaaatcatttgcccaggtcatggagctgttgtggggcacgctggggacaaagctccaagtccgttcggttgggcagaaaatggtcaactgcttgaccaagggttaaacagcaggggctaaacagagactccagcccctccctctgctccaccttgctcagtgccccacactgccctgcattccaccaaggtccgaaaggaaaccattcctcaggcgcctgcaagagaccaggcaggaaagctcagcgagggcgtgggccaggtgggaactgggcgagctcatgagcaccagccctggatggggaggcagcaacactgtcagactggcctgttaaaaaggagtatgtgaaatcttcagagtgtatcatctttgactaaatcaaaaagatgtcgtgttaactttcagttcctctaaacactcattcatcccaaaatcccgtttctgagatattagccaaatggtatctgtagcaatgactgtgggaagggagaaagtgatggaggaggaaagggaaaaaaacacacacacaaacacacacacaccacaccccacacacactccctcccagcacacacacaccacacacacatcctacacacaagcaccccccacacaccacacacacacaccctccacacacacacccacacacatcccacacacacacacaccccacacacaccctccacacacacccccacacacatcccacacacacaccccccacacacaccctccacacacacctaacacaccacacacatacacagcacacacatcaaccccctcacacacaacccacacaccctgcatcccccccacattcacccctcacacaccacacctcccccatacaccctccacacacacccccacgcacataccacaccccacacaaacacaccccacacacataccataccccacacaaacacacacaccccacacacacaccctacacacagacagcacccacacacaccacacgcaccccctacacacacaccacacacaccctacacacacaaaacacaccacccacagaccacccacaccccctacatgcacacaccacacacaccctccacacacacacaaacacaccacccactcacaccccccacaccacacacacgcgcacacacacacacacacacacacacacacaccctcgtctgtaggtccaacctctggtttggctttgagtgccccctcgtggttgaaacaggaacagcaggcaaaccccgcattttgggtgtggccagctgtgctctttcttttctggttctgggtccctgggattaagtgaccctgagaaatatgccaatctactcaggcaccctgttgccatattgctgtgcataacaatagtaatgtagcacaattataattatcacagtaatcacataccataattattgttttgataaatgtatataattaatgctgtacagaatatattattgtataactattctgatttataacaaaaatggctgctatttcttgagcctgtagcttggccagggataatgggctcagcagttcacgtgcacagtccctctggatctctctttttttttaattgagacagagtctcactctgtcgcccaggctggagtgcagtggcgcgaccttggctcactgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggagtagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttcgaattatcttccagaaaaactaagagcctgacgcaggcctttctaattccccactcagggtgggatgtggtacctggaccagcaaggctaaggagaagaataagcactcacgaatgcttgctctctgggcgatatatactcactatctctatccccaacttcccaaaatattaccagaaaggggtcctgatccagaacctcaagagagtgttcttggatctcacgcaagaaagaatttggggtgagttcataaagtgaaagcaagtttattagagaagtaatgacggaaaagaatggctactccacaggctaagcagcaacatgggctgctcagtcgcgtatacttgtggttatttcttgagtctgtgctaaaggggtggattattcatgagttttcctggaaaggggcgaggacttcccagaactgagggttccttccccttttagaccatatagggtaacttggaaattgccatggcatttgtaaactgtcttggcactggtggtcatgtcttttagcatgccaatgtattataattaacatataatgagcagtgaggatgaccagagggcactctcatcgccatcttggttttgattggtttggccagcttctttaccgcatcctgttttatcagcagggtctttatgacctgtatcttgtgataccagtcctgctgacctcctagctcatctggtgactaagaatgcctaacctcctgggaacgcagcccagcaggtctcagcctcattttgcccctgttctagatgaagtcactctagttataacaccactgacaaaaacaccctgggaagcacttggccttgccattgtatcttgtgagtgagaaccaaaaagcagagagaggttctgcaaaggtcaaacagccattggggactgggcaggatttgaatccaaatttacctggctttcctgctgcacccctaaccactaccccagtcgcatcctcaggaggccctgctgtgtgtctgcaactcaggcatcccatgcctcccctgcccagtccttcgggtccctaaagactggggcatccaggctccaggcttttgggatggtctgatgggctactgtctgaaggaaaggcaagaaaggagcggtcttcagggagatggatggagtttcttggttcccttgcaatcaaccacgaatgttcctcaccacacttgaccttgctttctggcagctcatcgctgctaaactcctctcccagaaaatggagcagctgcaaagagaggttaagatacagccctttgccctcccagcccccagcgtcacccttccatcagcaacccagcgtctgatggatggtgcctgcttacccttcagcacagaagccatctgtgacccctgcactaggccagggctctgcatgtccctctccttcactgtacatgtggattcattgcacaagaggtggtagctggctaacaaaaagagctgtttaaagtgaggactttctcatcgcacatcaacaaagaaaatattgacgtatgaacccaaatgttttaatggtggagtttcaggcagcgtctccagtgccccctcttcgagctgtgtcagtgaaggcccacagctattctttgaaaatggtctcttgattgacattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgttgtctgttccaaatttaatcttgcttttagaggggtttttttgtttttcgtttttttggttttttggttttttttgcacctcacctttccagagtatttatcttaggttttcatagaaagaacccttatagctggggccgggcatggtggctcatgcctgtaatcccagcactttgggaggccgatgggggtggaccatttgaggtcagaagttctagaccagcttagccaacatggtgagaccccagtctctactaaaattacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgtgtctcaaaaaacaaacaacaacaaaaaaaaaaactcttttctcaatgatattgcattagtgtacataataaataattcgagtaattacaaaagcaagtacagcaaacaggtggtaggctttcatgtggactccagtagggcccagttggacttttcaaagtctatcccaaggctgcatcataaataattcgggtgattacagtggcaagtacagccaacaagtttggaaatgcacatttccttctcttgagaagcaggccgcacaactggtggcaattgtgtgtgagtagcctacagaccccagcattcagtcttccaggagtaccagcaggaatggggaatactgatcagtccagccaatctgttcaggatgaccattaagaactatctacaggccgaatgtggtggctcacgtctgtaatcccagcactttgggaggccaaggcaggtggatcgcctgaggtcaggagttcaagaccagcctggccaacatggtgaaaccccgtctccactaaatatataacaattagctgggcgtggtggcacatgcctgtgatcccagctacttgggaggctgaggcaggagaatcgcttgaacccaggaggcagaggttcacccaggagggtgagccgagatcgcaacactgcactccagcctggccaacagggcgagactccatctcaaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctgtgtcagtgactccctagctcaggtgtccagccctgggacagactgaaaagtccaactggaccctagtggagtccacatgggggcccacatagttttattgtttgtatttccttggtacctggctcatgacaagcacttataaatatttgtaaatcagtgatcactgagcacacgtgtggaataatgtgactgcagtgatcagcaccgggccagaccagagctggggaactcactcagtcattctcttcccatgtttttcagatttgcgaaatgatccagaaatcggtgtcctccgatctacagccttatctccaaactctgccaggtaggacaccccatccatcccgggacacttttatttctgttaatttctataagagcatatatatatcttataaaatagtaaatggggcaaaaatatagaaagtaaaaattaagggccaggcgcagcggctcacacctgtaatctcagcagtctgggaggccgaggcgggtggatcacctgaggtcaggagttcgagaccagcctggccaacatggtgaaaccctgtctctactaaaaatacagaattagccgggcgtggtggcgcatgcctgtaatcccagctactcgggaggctgaggcaggagaattgattgaacccagaaggtggaggttgcagtgagccaagatcacgccattgcaccctaccctgggcaacaaagaccgaaactctgtctcaacagaaaaaaaaaaaaaaagaaagtaaaaattaaaagttcatttttctcccccacttttcttccaagaagtaacttctgttttgggtgtatcttttcagatattttctttgtatgtacaaatataaatacatgtaagcatataaatagacattcatgtatgtattattttgttcatgaatctatgtgtatatgtattattttaaatatatatgttcatatacatatagtataggcattgttccagatttcttttttttgagatggggtctcactctgtgtcccaggctggagtgcagtggtgtgatctcggctcactgcagcctcaaactcttgagctcaagtgatcctcctgcctcagccacctgagtagctgggactacaggtgcatgccaccacacccggctactttttgtattttttgtagagacagggtttctttatgttgcccaggctggtctcgaactcctgggctcaagtgatctgcccacctcagcctcccaaagtactgggatgacaggcacgagccactgtgccagcttgatttcatttttaaaaactttttattgaagtatatttataaagaaaagtgctcaaatcataagtgtgctgttaaagagtttttacatgcatgtaaccagctcccaaccgagaaacagaacacggctggtttttcagagcccctggtgtccccctcggtcactgcccagccctccagggtcaccaccatcccaacttctaccagcaaagattagttttgcactttgcacatgaatggaatcagacaatattttgagtctcttttcaaaagccagaaggctttctttgttcaactttaaaatatgaggtcagggctgggcgcggtggctcacgcctttattttttgttttctttttttttttttttttttttgtgagacggagtctcgctctgttgcccaggctggagtgcagtggcgcaatctcggctcactgcaagcttcgcctcgcgatttcacgccattctcctgtctcagcctcgcgagtagctgggactacaggcgcccgccaccacgtctggctaattttttttgtatttttagtagagacggggtttcaccatgttagccaggatggtcttgatctcctgacctcgtgatccgcccgctcggcctcccaaagtgctgggattgcaggcgtgagagctcacgcctgtaatcccagcactttgggaggccgaggcgggtggattacctgaggtcaggagttcgagaccagcccggtcaacatggtgaaaccccgtctctactaaaaatacaaaaattagccaggtgccgtggtggatgcctgtaatcccagctactcgggaggctgaggcaggagaatcacttgaacctgggaggcggagtttgcggtgagttgagattgtgctactgcactccagcctgggcaacagaacaagactctgtctcaacaaagaaaaaaaataataaataataaataaacaaaataaaatatgaggtcaggtcaggcttggtggtgcacacctataatcccagcactttgggaggccaaggagggagtatcacttcagttcaggagttcaaggccagcccgggcaacatagcgaaaccccatctctacaataaatacaaaaattagccaggcatagtggtgtgtgcctgtagtcccagctacttgggaggccaaggtgggaggatcgcttgagcccaggaggtcaaggcagcggtgggctgaaattgtgccactgcactccagcctgggccacagagtgagatcctatctcaaaaagaaatgaaataaaataaaacatgaggtccatgcatattgttgcatgcacctgtagtgtagctggtttattctccttgctgcatagtatatcaccatgtagatgtttccccatttatttgttcattctactgttgaaggccatctggggggtgttcagttttaggccattatccgtagtgctgctataaatgtcctagtacctatggtcgcatgtctttgggtatatatctgggagtgaaattgcaagctcgtcatatcatgtgatatgcccagattcagcattataagatcctgccaaacagttttccaaagtggttgtaacagaccttatttgttaacagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggcaaattatctgagatgttctctgatgccttagctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgcgcttgtctggaaactgcttaggccctaggctgagcatacacccccaccattgttaactcatccaagggaatccatgtagtgtctttcttgaagaagcaattctttgcctcagggccgggctagtagggggattctgaagaaagtcacagggaatgtgagtcagccagagcccttgcccctcctccagcagctgaaagtgtcatctggcccctaattctgccctgtcctcattcacagttacaacagagattgacagtttcgccgacattgattatagcttagtggaagcccctcgggcaacagcccagatgctggaggtgatgtttaaggtgagggtcctggggccgggctgcgtgggtgaggctttccctcagggtcagccattctttgggccacctgtccccccaacttcagatctgtcctcatcctcccagtggttcccgctttgtcaagggccgggtgatatggagtggtggggagtgtttccagagctaggattctcccacggctgtcttacacctctcaggtcttaacgcttccctcctccttcttcccctactttgccttgcccatcatgcagaaaaggccaatcagagcgggtcttagggagtgtagatgggcctagggcatatagaggggctggccaggacttcctgtgggttaatgtagcaaagcttctggtgagcttttcattaaaagacataacactgcctttaatggtggagtttcaggcagtgttccagccagcgtcccttcatcggactgtgtaggggaatacctagcccctgccccacgataggctttgaaaagtccaattggaccctatttccctctccagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatggtgaggatggtggcaaacaggtctctcaaatgaacacataacctaccgctccttccttctttccttttcacccctgttgacatcagtcaaatagtgagttatagctaagagaaaaatcaacaccaagaaaaatatgttagcacaatctccctttttactttggcaaccaagaaactcaaagccaaagttctttctcccatggctgggtgtggtggctcacgcctgtaatctcagcactttgggagcctgaggcgggcggatcacttgaggtcaggagcttgagaccagcctggccaacatggcaaaaacctgtctccactaaaaatacaaaaattagccaggtgtggtggtgtgcgcctgtaatcccagctacttgggaggctgaggtgggagaatcgcttgaacccaggaggtggaggttgcagtgagccaagatcatgccactgcactccagtctgagcaacagagtgagaccctgtctcaaaaaaaaaaaaaaaaaaaaagctcttcctcccttataacaactgtggaagactttgcagcttacttatctgtgttttgcttttctagacctgtttactagtctagacttgttagtctaattcatattttctctcatcctgatgatttctggaggtttattaaaaaatattttagtgaatgaggccgggcaaggtggctcatgcctgtaatcctcgcactttgggaagccaaggtgggtggatcacctgaggtcacgagttcaagaccagcctggtcaacatggcaaaacctcatctctactaaaaatacaaaaattagctgggcatggtggcacatgcctgtagttccagctacatgggaggctgaggcaggagaattgcttgagcccaggaggcagaggttgcagtgagctgtgatctcgctacttcactgcagcctgggcaacagagtgagactgcatctcaaaaaaaaaaaaaatatatatatatatatatatatatttatatgtgaatgaggcaagataatacatgcactgataaatgcatatattttcagagaaaaggaaataaagaccaagtgaaaataaagcacaattataaagacactgagcccttaaattaatttctttaacatctcaaacctgtcggggagcttccttgtagctaaagtgaaaaagatacatgatttcatgattcatggtgaaaaggagagacagtcttcctcacacccccaaaacaactgtttccaatgtggctttgtataagggagactgaattttacagtggatctcacctttaatggttctccagtttatctaatatttctgggtttcaaaaagttgtttcttgaagcacttcataaaagttgaggcctcatgaataatgtcaggatggtgggagaaacagtgtggttcggctcagacggtccagcttaccctggtataagtcaggggccgtctggtagatcgagggtcattttgtccttctgatggcctcctacacctgcacaggccttcgcttctggcatcgtgtttggtttacccatcctactgcggcacgggcctctctttcaatgggatgataatagctacgttttatggagcactcaccatgtgctgggccttgtgctaggatgttcgtttaggcctcacagtgactcgaaggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcgggcaggatgctgaagtcccatgtgctctccttgggtgaatgcaggacaggcatctcctccctgccagggtaacccaggctgtggagaagcgacagtcttgcacatccccctgcctccccaatcttctttagaccttcagctccagcgggagcaccctaaaacttcttcatgtctctttgctgcagataccgcctgactctaatatccgactgaccaccaagtccttccgacccttcgtcccacgggtaaggagtcccttagttccccatgagtgcagaccgagcctactagactccagaggtttctctttaaaacctctgcatctctcagcttgaccaagagtgagaaggccgggatgagactcccactgaaggctggggtgctgctcctttcaaagcctaaataacagaggccacgccccatatcttgtgggaccacagcttgtccaatcttttattggtgttatctaagaatcccaaggaatgctggcatagtccataaaatgtaccctaatgaacagcagctaacaattacagggggcttcctaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgatgaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccacccagttcccatctcaagtttgccaatattaccagattttacatatctttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtgttggctcacacctataatcctagcactctgggaggccaaagtgggggggtagcttgaggccaggagttcaagaccaacctggacaacatagcaaaaccctgtctctattttagaaagaaaagttaaaaaagaaagaaagaaagaaagaaatgttctgtggaatatcatattaaaagagtaatacgagaaaattaaatattttttttaaaaaagaaatggtgggatccagctgtgtcatatttcgaaaacactggcatctgacctcagcatgcccaattagcagaatgtgatgaggggatggagaaaccttgggagaggtagggagggagaaaaaatgggcccaacttttctggaggacaatttggcaatacctgccgaaagttttaaaagcattgctggccaggtgcggtggctcacacccgtaatcccagcactttgggaggctgaggcgggcagatcacctgaggtcaggagttcaagaccagcctggccaacatggtgaaaccccatctctactaaaaatacaaaattagccgggtgtggtggtgcacacctgtaatcccagctacttgggaggctgcagaaggagaatcgcttgaaccccagaggcagaggttgcagtgagctgagatggcaccattgcactccagcctgggtgacaagagcaaaactccatctcaaaaaacaaaacaaaaaaagaaagcattgctgtccttcaacccagcaactccacctctaggaatgttttcctgaaaagaatagccaagggtgctcacaggaggtggtcattataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgttcccagttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctggcccttacccccaatctaccttacgccccttgccactttttcttgtaacaccccattatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttaccacggcagaggctctggctgtgactatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacattgagagtcagttttccttttttgatggactctgtctaatagggaagggatgttgggtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgagcccaggagattgaggctgcagtgagccatgattgcaccactgcactccagctgggcgacagacagagactccatctctaaaacaataataataatttattattgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttgagcacctacagtgagccttctgggagtctatgatctagtgggcaaatttcctgctttagctcattgagctgtttgttgagaggagacagttggtccctcgtcatcatccttcctatacatacaaccttcatcacttacacctgcttccttcttctggcatttccaggccactaatgtgtccgccaccttgaccttcaataccagcaagatcactgggttcctgaagccaggaaagtaagttggcctcctacctacatgggggtgcccagctggactccatctgtatgctgtagctgcttctctgtagctggtgggagggggggccaccatttggaaaggacacttacatttcaccccaattggcccaattcttctgccccactggtcctgcccccacaaatctcaaattgttaaagaattcactaagactgttacttcttaatgtatgaattttagaagccagctatatgaacttcctgaaatgataaagagtgagctttttgacactatctcatctgccctgtgacagtcttcccgatgtcattgtatcactgcttttagttcctcagtcatcttttccactcctgctcccgccctacctttggccctgtgccttctcaagcccatcctttctcgcttctggggacccccgcattgcttaaacttgcataaagcccacaccttttaatcttctctgattcattacagggtaaaagtggaactgaaagaatccaaagttggactattcaatgtaagttgtttttattgatgacatgattagaatgttaattaatttggggtgtttcctaagcaattgctatggcacctataataggaaatacaaaaggagaagagttgattttttgccctgcagaagtgtaaaaggtctcgaaaacacaagacatagggccaaggaacagttatatcctagtataaaacaatatataattaagtcatctactgaacagaattctcttaactgcaagagacagaaagccaattgaaatcatcttaagcaaagaggagaaatatataggattatataattgaaaagcaaaaataaacgaaaaaactaagaccagaggtttcaggcatagctggatccaggtgttctaattagtgcatcaagaatctctctccatctctctgttctgttttcatttgtgttagcttcactctcaggcaggctcttccaattggtagcaagccccagagtttcctacagtttcagttttttaaaaaatttgcacacacacacacaaaatctctgtgctagctctcattggactaatcttaggcacccagtcttaagccaagcactgtggccagaagtcagcccagcatggatctcatctacactccaggaggcaggatttgcagtcagctacatccaaagcacatggaccaagactggcaaggagggttgttccctgggggaaaatagactccgttatcaaaacaagagggattgagtgctgagcaggtaaatccaagaagtgatttccacaaggtagaaaaagtggtgaagtagacggccccaaataaaaggaggaaagagaacgtgaaaatcagtgtgggccaaagttatggagaagagctttctggaaagagggaaggaggagctgggtagactttaatgtgtagtcgttggcttctcttttaccattccatgatgctggcctccactgaccacctccacctgtgccctgcctcccagactttcccgaagcacttatgaagtggaaacaaacacagaggcggtggggagagatgcagggaccctgaagctaactcctttcagagaataaagggtggagtgaataatggtgcactcatattgtatctgtgcgtgtttactgcaaagtaaaacattcaagtgagaagtttcacaaaaatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaactttgaggggttgttgtgaagattgaatcagacatgcacgtaaagctctgagctctctgcttggcatatagtgggggttagaagttgtgtttcatgattttggtagagaagcttattttgtttttattaaatttttaaaattatgtaggtagttcaggaaaaacattctcactgtaaataaaaccgatactaaagataaggctaaggacatgtcaaatgttgatgttcttcctttagaggaaagactgtcgggtgtgtaactttccaaaatttttctattcacttgcataccaaatgttcatctcaaaagagttttatcttataaaatagtagcatgatgtaatactagtttgcttttcccaagcgttttgctatgttggcacacacagaaccaccatgtggccctgtggcgatgtaaatatatctctcctgttctcttccaggcagagctgttggaagcgctcctcaactattacatccttaacaccttctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggattgttgaagttggcctcatctccctccagggctctaatgagggttgggggctgggacagctctttggagcacgggaaacctccttataagcgggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgggcaaagggcagggagtggaacgccctgttctttatcttatcatgaatgtgtgcttcctccagacagcaccatgcctgatagcttaggctcccaagtcagcctccctgggtttaaatcccctttctgacacttcctgtgtgacctagaacaagttacttggccactctgtgcctcagtttccttatctgtaaaatggaaagaataatcacacctacctcatagtcttggaaatcactaaatgggaatatactgaatatagagtttgcagagaacattttcggtaaaaatctgtctctaattattatttattcaccaatctctttcaatgttgtgcttcaacctctagataagttggccgaaggcttcccccttcctctgctgaagcgtgttcagctctacgaccttgggctgcagatccataaggtcggtgggttcaggggggctctgaggatgtgtgagggaggaggtggtttgcatgctagctttggggccatgattcatgggtgacacccagcccagccctgcagctgggaaagtctggccaggggcaggacgggtgctcctgggccttgccatatgccacaaagccatccacatgtccttcagaagtggcacctctgctggtgcaggtggcatttgacacagccctatgccaccaccacatcccatccctaccatgaggggcctgagggaagctcaagaccagctcgttttgaaaatactgcgggccgggtgcagtggctcatgcctgtaatcccagcactttgggaggctggggcgggcagatcacgaggtcaggagtttgagaccagcctggccaacatggtgaaaccccatctctattaaaaatacaaaaattagctggacatggtggcaggtgcctgtaatcccagctactcaggaggctgaggcaggagaattgcttgaatccaggaggtgaaggttgcagtgagccgagatcacgccactgcactccagcctgggcaacagagcaacactccgtcaaaaaaaaaaaaaagaaagaaaaaaaaaagaaagaaaatactgtaagtcctagacgtagcattaggtcaggttctgaaagtcatttgtaagttttaagcttttcttctaaattttaaggttgaagagctttattataaatacctgtttggcatgcctccccatttaaacaagtactacaaccatatatacttttttttttttttttttgagacagagcctggctctgtcacccaggctggagtgcagtggtgcgatcttggcttactgcaacctctgcctcccaggttcaagagattcttgagcctgagcctctggagtggctggaactacaggctcccgccaccactcccagctaattttttttttttttttgtatttttggtagagacaaggtttcacaatgctggccaggctggtctcaaactcctggcctcaagtgatatgctcacctcagcctcccaaagtgctgggattacaggcatgagacaccatatacagccaacactatatatgtttacaaaaattattcataaacctattgctccactacaagcacagtttgaattttggtgtacttctagtgctttttgttttaagggttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctactcaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttggcggactcattagcaggagggggatgctgcgctgtgcctggtacattgttaacaacagaaaataatagccattaaagggaatgaagggcaggggggatgattagggacctagaaacactggccaactgttctatctaaaaaacaaatgtcgaaagcccttttgggctctgagatactcagcacttaactgctcttgagcatttataagtagtcagacagatcgttgttcaaagcaaagattgagtgacagttcataccatcggcctcagttttctcctctgtaaaacgggacataaccgaaatgtcagtgggcttttgtgatgatttagagggcaagtatgatagcttctagctcaatgtttgacatgtggaaagtaattagatttattatatattataatattcattagaattttgaggtcaactctgcccatgtgtctaaccgtctaaaacaaaggatggatcactgtgggaaagaactgaacttggccttcggttcagaattcctgcccctctgggtgatggaaacgtaagaagagcaggagagtacaccctagcagttcacaatttttcattatttgccaaagagagaaaatttaggtgacgcaaaggacacttagaggcctgccgggcagcagcagctcggggaatgacagatcgatctctaccttggagaaggtagctgggaagagctgtgctttacggagagcttggggactgaggcacactcgcaatttatgcactgacctggattctggcagagcttgtgtttcgtgagacgtgggctccctttcaatcgcagatgcatctttttggagtagaggatgctctttaccatcctgtcctgtcctgtttttcctaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccctgactggcctgggatatctttacaagcaggcactgtatttttttattcgccatctgatccccatgcctagcagagtgctggcacttagtaggtcctcaataaatatttattaaatgatgagatgatggaatcacctggtattctagctgagcctcatcactgcctgccctcttctgacctcaggggtctttggatagtcagccacatctatggtctccaaggcccctttctcatcgccgctgctatgggagcctcaatgagagaaccagggattctgtacatcatgtagccctggatctggcgctggtgctccgtctctaaggcccttgtcctgtctcaggcaggggctcacttcgacatcgctccctccctcatttcttgcctgctacagccaagggagccaatgatctcccggagcaaaaactcagcctcccgctgcttttccctcattgaagcaggtgtaaattaggaggaaatggatctgtctaagtttttggtccaaccccaataaaaagctcatccaactgttgtttatgagccccaagcctggagggagaggccgtgatttctaattactgaacaatgagcctttgatcagactaataaagagtcatttccaagttatgtagttgggctcccagggactgggagtcagaagactcgtttgataattttttttattgtgttaatgagcagatggatggagcttcaggctagcagataattcacagggaataatcccatttaccctgtgtgtgacagagatgtgttccaagatgggacgatgtgttgtcgcccagctggtggcagggtaagctgtggcttcaagccctctctcctctccatttttgttcatttgtttgccaccatccatccctatgaccgactggcaaaggacacaggcttcatccagtactagccatgtggccttgggaaggtcactttccccctggggtcctcatctatgaaatgatgatgatgattatagtagtcaattcctgggactgctataatgactgcattgggtaatctatgtggaaggatttatttagccaaatggggattccatatttattggctgggtgtgcttactaagcacctcctatttgccaggctttggggtcctcatggggagaaatacatggagcatgggctccattcctgatcctgcttttaagagtgatacttcctctccctctccctctccctctccctctccctctccctctccctctccccacggtctccctctccctctccctctccctctccccacggtctccctctccctctcccctctttccacggtctccctctgatgccgagccgaagctggactgtactgctgccatctcggctcactgcaacctccctgcctgattctcctgcctcagcctgccgagtgcctgcaattgcaggcgcgcgccgccacgcctgcgtggttttcgtatttttttggtggagacggggtttcgctgtgttggccgggctggtctccagctcctaaccgcgagtgatccgccagcctcggcctcccgaggtgccgggattgcagacggagtctggttcactcagcgctcaatggtgcccaggctggagtgcagtggcgtgatctcggctcgctacaacctacacctcccagccgcctgccttggccccccaaagtgccgagattgcagcctctgcccggccgccaccccgtctgggaagtgaggagcgtctctgcctagccgcccatcgtctgggatgtgaggagcccctctgcctggctgcccagtctggaaaatgaggagcgtctctgcccggccaccatcccatctaggaagtgaggagcgtctctgcccggccgcccatcgtctgagatgtggggagcgcctctgccccgccgccccgtctgggatgtgaggagtgcctctacccggccgccccgtctgagaagtgaggagaccctccgcctggcaaccgccccgtctgagaagtgaggagcccctccacccggcagccaccccgtctgggaagtgaggagcgtctccgccaggcagccaccccgtccgggagggaggtggggggggtcagccccccgcccggccagccgccccgtccaggagggaggtgggggggtcagccccccgcccggccagccgccccgtccgggagggaggtgggggtcagccccctgcccggccagccgccccgtcggggaggtgaggggcgcctttgcctggccgcccctactgggaagtgaggagcccctctgcccggccagccaccccgtccgggagggaggtgggggtgtcagccccccgcccggccagccgccctgtccgggaggtgaggggcgcctctgcccggccgcccctactgggaagtgaggagcccctctgcccggccagccgccccgtccgggagggaggtgggggggtcagcccccagcccggccagtcgccccgtcggggaggtgaggggcgcctctgcccggctgcccctactgggaagtgaggagcccctctgcccagccgccaccccgtctgggaggtgtgcccagcagctcattgagaacgggccatgatgacaatggcggttttgtggaatagaaaggggggaaagttgggggaaaagattgagaggttggatggttgccgtgtctgtgtagaaagacgtagacatgggagacttctcattttgttctgtactaagaaaaattattctgccttgggatcctgttgatctgtgaccttacccccaaccctgtgctctctgaaacatgtgctgtgtccacccagggttaaatggattaagggcggtgcaagatgtgctttgttaaacagatgcttgaaggcagcatgctcgttaaaagtcatcaccactccctaatctcaagtaccccgggacacaaacactgcgaaggccgcagggtcctctgcctaggaaaaccagagacctttgttcacttgtttatctgctgaccttccctccactattgtcctatgaccctgccaaatccccctctgcgagaaacacccaagaatgatcaataaaaataaataaataaataaaaagagtgataggtgtgctgaaaagagccagtattgattccagcctacctgttttgggtccctgggcaaggtatctccaagcctcagtgtcctctcctgtcaaatgaggctgggaagagctcttggcgggattattttggaaattgatgggttcaggttaagcttccgtgggtgcccagagaataaccaggtggtggtcaatggatgacacaattagatcacctgtcatacttggtgtccccagaagcagaccctgaagaaaagaggtgagtacaagtatgacggtgttgcaaaagtaattgtggtttttgctgttactttctttttttttttttttgaggtagagtctagctctgtcgctcaggctagagtgcagtggtgcaatctcagctcactgcaagctccgcctcccgggttcacgccattctcctgactcagcctcctgagtagctgggactacaggtgcctgccaccacgcccagctaattttttgcatttttagtaaaggcagggtttcaccatgttagccaggttggtcttgatctcctgacctcatgatctgcctgcctcagcctcccaaagtgctgggattacaggcgtgagccaccgcgcctggcctgactcccagtcttttctccagttaatctttcctgggtttttgatgagattcctaggaagggggtcttaagataattgcatttcttttggaaagaagttttcttattcagagaaggaaattccagacagagtcccttctggtgcttcaggaaagaggatcagagagctaaggaggtgagggaagatcagagggagaccttgagtctgcttttttagttcagcatatcaatgtgccatatattggcgtattgttttctgagccccaacagtgttatatctcgatggggtagtacaggacaacacagctggccctagagtcccatagcaggttctgacgccctgaaatctgactgtaaacatatgagtatcctggacagctccaacctgtagagaaggactggccttgggacaggatgttctgatctcaataaccggaagaactggactgtcaaagaaccttcaagagaccacagactcattgctgtgtagatctcattctcacacaaaaccaagatgccaccttggagcgcctcctcttgactacaacctgttcctcccttctgcccttctctgatttcccctctcctctcctcaacctgatcaagacctctagcctcaccggtgtcttccaggccgctattctgatttaatttgtctccataactaagcacagttcatcatctctaacagaatcctttcatctcctgacaatcttactttccacatccccagcctggggcctaggcgtaggtaagagaattaaattactggaggaaaaggcaggcaggctatagccagttgaggtctccttccatcaccaaaaccatagttctgtctgaatggcctgagcagcagcaacagcctagaaattggaatacatgatatttctaatgaggctctcaggtaaggtctcagaacccattcagtctcaagacatgctttttgtttttgtttttgtttctttgagacaaggtctggctctatctcccaggctggagtgcagtggcacaatctcggcaaacgacaaccttcacctcccggactcaagccatcctcccacctcagcctccagcatagtgggactacaggcatgcaccaccatgcccagctatttttgtgtgtgtgggtatttgttgtagagatggggttctgccatgttgcccaggcaggccctgaacttgtgagctcaggtgatccgccggcctcagcctcccaaagtgctgagattacaggcaggagccaccatgcccagctgcatttcttctttctttttatttattttttttgagatggagtttctctcttgttgcccaagctggagtgcaatggcatgatctcggctcactgcaacctcggcctcccaggttgaagtgattctccagcctcagccgcctgagtagctggaattacaggcgcccgccaccatgcccagataatttttgtatttttagtagagacttggttttatcatgttggccaggctggtctcaaactcctgacctcaggtgatctacctgccttggtctcccaaagtgttgggattacaggtgtgagccaccatgcctagcctgcatttctttctaagagcccaagatgaagcttagaagaaaagacactagcatgccaggatagtccatattgtgctgtaagtgaaggcagcatggagaagtcttggcaatataggtaacaaggtcaggggcagccacaggtctgaataggtggaaagatgagagctgctgggtatagtatcaaagggttaggcaaacaatagaaccaataagtgtgcgtgtttggaaaggacagaagaagaaaacaaaataaacaaaaccaaaaccaagtacagcattgggccccagggattagaaagtcaagcaggagctagcacggccaatgcactttgcttctttcactggaaaagtccaaaatatattttcctattagtacacagagatcttctgcatttgatttttaaaatttaacacagctacataatattccacatttgtgtatgtacaaaacgacttcttcattcttatttaaagatgcataggatctcctagtgaaagatacaatttatttaaccagttcctacttatgggtcatcaggttgttttaaaacttttgcttttataaataatgtttcagtgaatacctgtattcatatgccaattcatacgtgtggaggtacattgtagaataaatgcccagaaatcaaatcctataactctgactctttggttaatttagcagattgtcatttgctcactttctcttctttccagactttccccttctcttgaggtggtgcctgggtatacagggatgttgaaggggtccacatggcatcatgagagtggagtgaagcaggacatagtaaagaatttaaccttgctcaaagagagacatggcttttgtccttggcccctggaaggtaatctctaagcccttggaatgcttgcctggtaagagtgcctttgtttacctgggggcattggtccataacagatagtctaacaaggggagccacggcagggcttttgttcacatcatatcagcttaatctctgaagatgctgaagactgagcccagccacatgggcagccaaccagattggcatgatcaaggccccaaaagactctggagcttttcagatgattttcaggagaaatgactgagcccaaagaacaatagcctggaaggaagttcctatgagtgctgtgggaagtggtgggaaggtgaggggcggaacttcacaatgcacaaaggttgtcttattatgcagatgaagtctccccggtaatctctgagctgcactcagaggatagatgaagaagtctgggcgtggcgattactccaagtcttttctctggttaatctttcctagctatttgatgagattcctaggaaggggaccttaaaataattgcttttattttggaaagaaggtttggctgagtgtccccagttggcaatacttcatgtgtattgtcacacatcaatgctagaaaagtgatgctgtccacgaccccagggagagagggcagctggaagctctgcgttagaactttcttggactctgccctatgttgctcttcccttggctgattttaattggtatctttttgctgtaataaaatataaccatgagtataacaactttaagtgagttctgtgaatctttctggcacattttcacacttaagggttgtctgggccactcctgaacttgcaattggtgtcagaagtaagagtggtcttgtgagcaatgctgcctctaacttcacacaaggagtcttctcctcctcagctccttcactcactggacatcctgctggccacagatgctgcctgagcatgaggccagtgacacagagacctgttccctgtggcctggtcaaggcctaaagtccctcacctcctgcccccagctgctgcatcttcagatctgctacaaaccctgtattgatcaggcttcctacctgcaaactttagcatccactctgggtagtataggcagaaaggggtttgttaaaggacattagattgttctcaaatggttgggaggagaaacagagttgaggctgagcttccaaactggtcacaggggttaatcagatgcagaccacaccaggacatataagctcactttctcattagccccactgattttttaaggtattctatcatacaccaggatcaacatatacttataaaattcctttgtctttactatttaagattgcaacacttatttagtgttcaattatctgcttgtgaaatacttcttagcccagtgcttctcaaacttcaatgtgcctatgaatcccctgagcatcttattaaaatgcagattctgatgcagcaggtctggggaggagctgagaatctaaccatcttccaggtatttccaatgctgctggtccttgagtaacaagatcaagtaaactttgtgggagtaagaaatttctcactgctatataaccccctagaacagcacctggcacatagtaggtgcacagttagacatttgtcacatgaatggatttggcccatagatccaacatggtccagcttcgccctccatccagcactgtgtgaattgttggtctacagaacgttcagtggtctggagcccaggagagaaaactggaaatttctcaaaagccaagtagtgacagaaaatgattcagtcgctgatatggtttggctgtgtacccacccaaatctcattttgaattgtagttcccataatccccaagtattgggggagagacccagtgggaagtaattgaatcatggggtggctacccccacgctgttcttgcaatagtgagtgagttctcatgagatttgatggttttttgtttgtctgtttgttttttttagatggagtcttgctttgtcacccagcctggagtccagtggcacaatcttggctcactgcaacctccgcctcccaggctcaagtgattctcctgccttggcctcccgagtagctgggattacaggcacctgccaccatgcccagctaactgtttgtatttttagtagagacagggtttcaccatgttggtcaggctggtcttgaactcctgacctcaagtgatccacccggctcagcctcccaaagtgctgggatgacaggcgtgagccactgcacccagctgagatctgatggttgtataaggggcttttccccttctgctcagcacttctccttactgctgccctgtgaaaaaggtaactttctcctcctccttctgctatgattctaagtttcctgaggtcttcccagccatgcagaactgtgagtcaattaaacctatttccattataaattacccagtcttcggtgtgtctgcatagcagtgtgaaaacagacgaatacagtcaccttgttgaggtcaagtggccaatttttgcaacattgctagatcagggtctcagtgaaaaacccccttttaggaagaaggcacaaatttcccatatagaaaaattctaagtaatgtatgtaaacactgccctgcaagaagttgggagcacagctctctgccccttaagtatgggctacacttagtaacttgcttccaaagaatagagtatggaagagtggtggggagtaaatttatcgagaaacctgacaaatactacattagccaggtgatcaaggtaaagatactcagtgataagtcatgttgatagtaggcatcttagttcaggctactctaacaaattaccatagactgagggacttaaaccacaaacctttgttctcaagttttagaggctggaagtctgggatcgggatgccagcatggccagcgagggccctccactgtgtggcaggctgctgacttcccactgtctcttcacgtggtggggagcaaagagagggaagcaagctctctcatatcttgtcttctgatggcactgtttaatccaggttagcgtaaagctgccttattttgaagttcagcctaaagattcctctgtacatcgtgaactataacctaaatggagttgtaaacagaccataccctactcttgtgccaatcaccgagttttggccaatcaaaagtggccaactgtttaaaccgttcaaataaggcaaacatagagctgtaaccaatctagctgtttctgtacctcacttccgttttctgtacctcacttccgttttctgtacatcacctaactttttctgtccataaatcttttaccaccacgtgctatgctggactttcttgagcctgctctggttcaggaagctgccaattcgtgaattgttcttgttccagtaaactcttttaaatttaatttagcttaagtttttctttaggctggatgcggtggctaacgcctgtaatcctagcactttggaaggccaaggcgggcagatcacttgaggtcaggagttggagaccagcctggccaacatggcaaatcctggtctctactaaaatacaaaagttagtcgggcgtggtggcgtgcatctgtaatcccagctactcaggaggctaaggcaggagaatcgcttgaacccaggaggcagaagttgcagtgagaatgagaagagatcgtgccattgcactccagcttgggcgacagagtgagactccatctcaaaaaaataataaattaaaaataaataaataaaataaaataaagtttttattttaacagtgctaattctattcatgagggctccattttcatgacctaattacctcccagaggccctacctccagatattatcctattgaggatttagatatcaacatatgaatttgagcaggaaacaaatattcagtccataacagtaggtgtctctgacatggtgagatgagaatggcactcaatggtcttcctccccaaaacccgtggtgaaaaacatcagacaaacccaaattcaatggcattctacagaaactgttggtcagtt

SEQ ID NO: 1128 - DNA, 32957 bp, Homo sapiens
gagtttgagaccagcctggccaacatggtgaaaccccatctctactaaaaacacaaaaatagcagggcatggtggcgcacgcctgcaatcgcagctactcgggaggcggaggaggcagaattgcttgaacctgggaggcggaggctgcagtgagccaagatcatgccactgcactccagcctgggtgacagagtgagactctgtctcaaaaaacccaaaaaaccagaaaaatatgggtaacagaaagggaagaactctctccccacgtgactcaatattgagaaaacttacttgacatggttgtcatggatttggaagtgagatggcctctgagttcaaatcctggctgtgtcccttccactgtggctgaagcttaacacttgattggcgtgtgtgggatatgagcccagtgtagccagaagaaggtactttctccggttgctgcataaaagccagcaaaggcaggctgtccccggccttctaggctttgtgtgtgattctccttctgcctggaacactgttgcttccccatttcctacttacataatatttctgcatttaacatctttgtgcctcagcttcttcctctgcaaaatggagatgataagagtacccactttatggcactactgtgaagaataaatcagcttaaattagccgtccgggcaaggtgcctaaagcctataatcccagcactttgggaggccaaactgggaggatcgcttgagcctaggagttcaaggccagcctgggcaacgtggcgaaaccccatctctacaaaaaatacaaaaaaattagccgggtatggtggtgcatgcctgttgtcccagttacttgagaggctgaggtgggaggatcacctgaacccaggaagtagaggctgcagtgagctgtaatcgcgtcacagcaatgtagcctgggcaacagagcaagaccctgtctcaaaaaccatataaagagctgaccaacatggtgaaactccgtctctactaaaaatacaaaaaaaaaattagctgggcattgtggtgcatgattgtaatcccagctacttgggagcctgagggagaattgcttgaacctgggaggtggaggttgcagtgagccgagatcgtgccactgcactccagcccgggcagcagagtaagactctgtctaaaaaaaaaaaaatacacacacacacacacacacacacacacacacacacacacacacacacgtatatatgccaatacatgaaagcaatcttttttttctttttttgagacggagtcttgctctgttgcccaggcttgagtgcagtggcgcgatctcggctcagtgcaagctccgcctcccaggttcacgccattctcctgcctcagcctcccaagtagctggaactacaggtgcccgccaccatgcctggctaatttttagtatttttttagtagagacggggtttcaccatgttagccaggatggtctcgatctcctgacctcgtgatccacccgccttggcctcccaaagtgctgggattacaagcatgagccctcgcgcccagcggaaaaagccaaagtctttacaatgacctctagggcttgacattatctgactcatcttttatcactctttgcatctctgccttcgttccgcatgtattgcttgtgccaggcacattcctgcctcagggcctttgcacttgctattgcctctgcctagaatgttctttctccaaataactgcatgactggtcccctggcttctttctggtctctactcaaaaggcccctctcagtgtgacattccctggctatcctatcaaaatgtcaacacccctctgacatgcctgccaaccatgctttgtgtattttctcctttgtatttattactattccatatatcaaacatcttactcatttatcctccactggaatgtaagttctaaaacattagaaaaattttattttatttttttcaaggtctcgctctgtcactcaggctggagttcagtggcacaatcatagctcactgcagccttgaacttctgagtttaagcagtcctcctaccttgcccttccaaagtgctgggattatagacatgagccgcaatgtctggcccagaaattttgtttattttgttccctgaaatttcttcagtgcttaaaacagaggttagtaaaatttgaaaaatgaatgcatacgtatttttttccattttaatcttcccagtaagatacttcagtattgtctccattttgtagattaaaaacctgaggcacagagcgatcaggtcacttgcctaagggtcatacggctgggaagtgtggctcaggggaagactctacccccttacctcagatttcttatcatttaaatgaggtttccaaaagaatgccctctttgcagggtcattgagacatattgtgaagattatgtgtgatagagcatatgacaaacttaaagccagtgcttggcatgctgtaatcactcaagaagtagtctctggctgagtgaggtggcacatgcctgtaattccagctacttgggaggctgaggtgggaagatcagccaatcttgggaggcagaggttgtagtgagctaagatcgcaccactgcactacagcctggttaacagagtgagactccatctcaaaaacaaaacaaaacaaaacaaaaccaaaaaaaaaaacagaagtagtctctagaaatacgaaaggatgtacgaggtgtttgtccctagtcattaaaggtaggaatatttcagcacagaggctgatcaaggggccaggaagttactagtattgtttttgtttttgtttttgagacagagtctcactctgttgcccaggttggggtagagtggtgtgatctcagctcactgcaacctccacctcccgggttcaagcaattctctgcctcagcctcccgagtagctgggattaaaggcaaccaccaccacacctggctaatttttgtatttttagtagagacggggtttcaccatcttggccaggctggtcttgaactcctgacctcgtgatccacccgcctcggcctcccaaagtgctgggattataggtgtgagccaccgcgcccggccttgttttgtttttgagacaaagtctccctctattgcccaggctggagtacagtggcatgatcttggctcacttggcctattgtcgttaatattgttgtcgtttctatcacttttctgtgcagcagggtttagccataccaacctgttcccagaatgagctcctctgtgaccatgacacatactgggtcctctgcttggaatgcatttagcgtagtttctgcacggaaactcatatgcatccttcatggcccaactcaaaaatctcctctgggaagcttctcctgacttcctgaggtatgtcacattcctgttatagttagggttgcaatttatttattgatttgttttttgtttgtttgtttaatctgaagcccctaccagtctctgaggtcctggagggccacattttgtgggtcctgaagcagaaacaatttgggggccctctttaaaatatgaaattattaacacaaaatcaggtttgaggccagatgtgctggctcatgcctgtaatcccaacactttgggaggctgagacgggtggatcacctgaggtcaggagttcgagaccagcctggccaatatggtgaaaccccgtctctacaaaaaatacaaaaattaactgggtgtggtgatgtgcacctgtagtcccagctacttgggaggctgagacaggaaaattcgttgaacctgggaggcagaggctgcagtgagccgagattgtgccactacactccagcctgggcaacagagcgagattccatctcaaaaaaaaaaaaaacaaaaacctggtttgaaagtgaatatttatttagaatgagaaaaaatcccaacaagttttgaaatgtaaaaaacggacaaataagacaaaaaataaaatccaaaataataacaaacttttattaactgcttaacattcttctataatacttttttttttttttaaatagagacagggtctcacaatgctacccagactgagctcaaactcctgggcgcaagcaatcctcccacctcaacttcccaaagcactgagattgcaggtgtgagcctcagcacctggccttttttgcttactttttttttttggctgcacactttttgattctttatgtgacagcaactgtatggtattttctctatttttttttttgctagatggagtcttgctctgttgcccagggtggagtgcagtggaacgatcatagctcactgcagccttgagctcctgggctcaagcaaccttcctgctgcagcctcccaaggagctgggactacagatgcataccaccacgcttggttaatttttatgttttttgtagagatggggtttggtcactctgttgcccaggttggtcccgaactcccagcctcaagcgatcctcccacttccacctcccaaagtgctgggattacaagcatgaaccactgtgcctgggcagtaggattgtttttgtttttgtttttgagagcgagtcttgccctgttgctcaggctggagtgcaatggcgtgatctcggctcactgcagcttccgtctcctgggttcaaacgattctcctgcctcagcttcccgagttgctgggattacaggcacctgccaccacacccagatattttttttgtatttttagtagagacagggtttcatcgtgttggccaggctggtttcaaactcctgacctcgtgatccgctcgccttggcctcccaaagtgctgggattataggtgttagccaccgcgcctggccaggatatttttatagcaggactggaaagataattcagtctttcctctgccatgattgatcaaaattagtttttttgtgtgtttttgtttttgtttttttttgttttttgagacggagtctcgctctgtcgcccaggctggagtgcagtggcgcgatcttggctcactgcaagttctgcctcccaggctcacgccattctcctgcctcagccttctgagtagctgggactacaggcgcccgccaccacacctggagaattttttttatttttagtggagacagggtttcaccgtgttagccaggatgatctcgatctcctgacctcgtgatccgcccgcctcggcctctcatagtactgggattacaggcgtgagccactgtgcccagcccaaaattagttttttattagtgatagtttaggaatttttttccttcagttttgtaattcattgttggtaagattatttaactcaatgattgttgttaaatttggagcaactgctataaaatatcttactcatgtgagctgtgtatttggaaggattttccacacactatttctgacttcgtgcatttcaaattttatttcttttacaatgcccttgtactcctggggctgggcatcatatattctctgagtcagcaccttcagatcacaacactcagggagacagaacaatggcattaggaatattcctgaatgccatctggggcacctaggagtaatataactatacccgcaaggggccagaatcccataaatatactcacccccagccctaaacccaaatcagcctctccctagccagatttcaaaacacctgtggccacctgatatgaagcgaggtgtgatgaaggagaggttgggagtggaaagagaaaaaagtctgaactaactgtggttaaaatatcttatgtttgcaaaatttttattttaatttatttatttttacttttttgagacagtctcactctgtcgcccaggctggagtgcaatggcacaacctcagctcactgcaacctccgcctcctggattcaagcaattctcctgcctcagcttcccaggtagctgggaatccaggcacataccaccacacctgctaatttttgtatttttagtagagatggggttttaccatgttggccaggctggcctcaaactcctgacctcaggtggtctgcctgtcttggcctcccaaagtgctgggtttacagggtgttacaggggttacaggggtgagccactgcacatggcctatttttatttttttaattttttatttaattaattaattgtttttgagacagagtctcgctatatcacccaggtgggagtgcaatggctcagtctcagtttactgcaacctccgcctcccgggttcaagcaattctgctgcctcagcctcccgagtatctgggattacaggcgcccaccaccacgcccggctaatttttgtatttttagtagagatgaggtttcaccatattggtcaggctggtcttgaactcctgacctcaggcaatccacctgcctcggcttcccaaagttctgggattacaggcgtgagccaccgcgcctggccacgcccagctaatttttgtatttttagtagagataggttttcaccagtttggccaggctggttttgaattcctgatctcaggtgatccactcaccttggcctcccaaagtcctgggattacaggcgtaagccaccactcccaaccctatttgtattttttaaaaattttatttggcttgaggcacagtatcaagaggtcctgagaacatgtacccctcatgtttgcaaaattttaaaaaattatggcaagaaaatacataacagagcttactatcttaaccatttttttctgagatggatcggctctgttgcctaggctggagtgcagtgtcatgatcatagctcactgtaacctcaagcttctgggctcaagtgatccttctgccttagcctcctgagtagctgtagtatagctaagagtgtaggcaccacctaattttttaattttaactttaattttttgtagagacagggtttcgctatgttgccaggttggtcttttttgtttttgtttttgaggcggagtctcactctgtcgcccaggctggagtgcagtggctcgatctcggctcactgcaacttctgcctcctgggttcaagagattctcctgcctcagcctgccgagtagctgggattacaggtgtgtgccaccacgcctggctaattttttgtatttttttgtagagattgggcttcaccatgttggccaggctgctgtcgaactcctgacctcaggcaaagtgctgggattacaggcccaggttggtcttgaactcctggtttcaagcgatcctctcacctcaggctcccaaagtgttgagattaaaggtgtgagccttgcacctggccagtcttagccattctaagtgtacagttcagtagtgttaagtattttcacagtactgtgcaacagatctctaaaacattttcatcttgcaaaactgaaagtttataaccattcttacttttgcaaattttatgaagacatataatcccggccgggcgcggtggctcactccggtaatcccagcactctgggacgccgaggtgggcggatcacctgaggtcaggagttcgagaccagcctgaccaacatggtgaaacccccatctctactaaaaataaaaaattagctgggtgtggtggcacacacctgtagttccagctactcgggaagctgaggcaggagaatctcttgaacccgggaagcagaggttgcagtgagctgatatcatgccactgcactccagcctgggaggttgcagttagctgagatcatgccactgcactccagcctgggcaacagagtgagactccatctcaaaaaaaaaaaaaaacaaacaaaaggtcgggcgcggtggctcacgcctgtaatcctagcactttgggaggctgaggtgggtggatcacaaggtcaggagatcaagaccagtctggctaacacggtgaaaccccatctgtactaaaaatacaaaaaattagccgggcgtgatggcgggtgcctgtaatcccagctacttgggaggctgaggcaggagaatggcgtgaacccgggaggcggagcttgcaacaaaccaagattgcgccactgcactgcagcctgggcgacagagcaagactcagtctcaaaacaaaaacaaaaacaaaaacaaaacaaaacaaaaaccatataatcccatgcaggtgatgagttctgaagtttaagcttcagtgggcttcatgataaattcattcttgctgagggaagatttgagtctttttggagttccccaaggtacagatttggacatcatacactgtaggaaatcaaggttgcatcaaatgaccgctccaggagggagagctgttagggaataataggtccagaggtgtttgttttgggtttttttttttttttattttatcgcccaggttggagtgcagtggtgcaatctcggctcactgcaatctccgcctcccgggttcaagcgattattgtgcctcagcctctgtgccacaacgcccggctaatatttgtatttatagtagagatggggtttcaccatgctggccaggctgctctcgaattcccaacctcaggtgatcgcctgccttggcctcccaacgtgatgggattacaggtgtgagccactgtgcccggccaggtccagaggtcttaaccttctcatggattcctgggattttgaggtggtgtctcaggcactgccaatttgggctgcttagctcctcccctcccccacacttgaaacatctgcttaaataataacgatgacattaatgatcatcattcaagctgaaatacattggttactttactacatgatagacactattccaagtaccccacttgtattaagttacttaattctttttttttttttttttttgagatgaagtctcactctgttgctcaagctggagtgcagtggcacaatctcagctcactgcaacctccacctcccggattcaagcgattctcctgcctcagcctcctgagtagctgggactacaggaatgcaccaccatgcccggctaattttttttgtatttttagtagagatggggtttcactatgttggccaggctggccttgaactcctgaccttgtgatccacccacctctgcctcccaaagtgctgggattacaggcatgagccaccaagccaggccaagttacttaattcttacaatgcaactatgtggttggaattaatcattatcccattttccagagaaggatgccagggcttgaaaagcttcagttttatagataaaggttccttgtaacataccttttgaaaaaaaattgttctactaataacacgttttgaaaaagtctgaattagtccagggtatttattttacacatgggaaagtaaaatccagaaaaaggggtcatttgttcaatgccacacacttattctttcattatttcctgggcgcctgccttgtgccagtgactgtgctatgacataagggttcagaggtaaacaagatactcatggaatataattttagtggaggccagtggacaatatatacaagaagaaatgaataggcaaaataattccagacagtgctgggatgatacatttgagatgtgattgagtgacaaagagagagagtgttaatttagttggagaggtggtcaggagagtgtggtctgtggaggtaacatgtgagccacaacctgatgacctgaagaagtcagccgtgcactgctatggggggacaacactccagacagagggatctatgagtgcaaaggccctgaggcaggaatggcttgttagtaatacagcagactcctggtccagtgctccttctctgcctgctgctctctaggccctcagagaggctcctttggtgtcctggacctccctcaagctcagtccctaaggggccagctgatctaggaaggtagcagatctggcttcctgtgggtcctcctcccagaagccctatggctgaaccggatctgagtttcctggttcctgtctggcagaaggggagcagatctcctccctgcctcctctccccaggctctagcccttgctccaaatctccatggcaacccctggacacagttctgaaccaaatgaagaggatctggaaggcaaagcactaagatcatagtgaagacttgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacaggtaagtatcagggggcttggttggggcacccagaagacttgggcccccaccatccttagagactatgtttccccagtcagcactcatcctgctgggctgagaccttttgagctgggggaggctgggaaactgtgtctggtcttgcttggcatccccaaatccaacccaaagccttctggaaggcttggatctgccagtcacctagaagcaggagtctgggagtgggcaggacagccctcagggcctgctttgcaaaactctgtaggcttcggattcagagaagctgcatttacacactctgccacttcttatgtttgtacctttgagatcattgtttcaactctctgaatttctttggcagtaaaatgaaaataataggcccttgccccttaagggactatgattattggcatataagatgagataagtcatgcaaggcacttcataatacctggcacataaaaggtgccaaattcccggctgggcgcagtggctcacgcctgtaatcccagcactctgtgatgccgaggcgggcggatcatgaggtcacgagatcaagaccatcctggccaacatggtgaaaccacatctctactaaaaatacaaaaattagctgggcatggtggcatgtgcctgtaatcccagctacttgggaggctgaggcaggagaatcgcttgaaccagggagtcggaggctgcagtgagccgagattgcgccactgcactccagcctggcaacagagagagactccgtctcaaagaaataaaaaaaaaaaagggtgcccaattcccttactctctaaactccatgcctgccctgtgtaccttcagggtaggctctggctttagcagagaaataccaaatattggaaagtgctcccacatcctgagctctgatgaaggattttttcctcaaagacccacatcctggctggtcctcaagtacccactggtccctatcttgcaccagaaaacccacctcctctttcctctctgtgcttacagaaatcagggctactttgagtacttgcacatcttctcatttaatcctcacaacaaccctgtaccagtgaggatgttttgggctgtaagtaacagataacaaactaaatggggcttaaatggtaggatatttgctatttcagttaagagtggtcataggtgattccagagatggttaactcaacggctcaacaatgtcactgttcctctgaaatgctctgacctcatctttgcaaaatggctgctgcagctctggacatcccatcctcatcctcagtcagcagctttcaaaagcaggaagaaaaggggctccttatcacacagctctccccctccccttttttttttttggtgacggagtctcgctgtgttacccaggctggagtgcagtggcttgatctcagctcactgcaacctccgcctccagagttcacgcgattctcatcctcagcctctcgattagttgggattacaggtgcgcaccaccatgcccggctaattttttgtattttagtagagatggggtttcaccatgttggccaggctggtctcgaactcctgacctcaggtgatccacctgccttggcctccaaagtgctgggattacaggcgtgagccactgcgctcggccccgcatcttagggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggtgagctggggctgaaggccgggacgggaccctctgcagaggccatgcgggactggggccacagtgggggccccggtgagggccgctgccgacaggggaatggcaggggtgcccgaagcacaagatggcagggactgggtccaacgggagggaagaaggtggtggctagtggcagagtcacaataagggacctcccggatcctaagagccaaccatataaatctggctaccatggatgtgtgcgtcagactgtcctaccagccccagtgcgcacacacatccacacacatccacacacaacttcctccccacacacattcacacacaactcccacacgttcacacctcacactctgacatccacacccatgtcacatacgcacaacccacgcacctcatcgcccccacacactccacactcatgcctctcactgcagcacacgcctcacactgcacactcaccatcacacacctcatatgcacacagtaccgccttgcacacttacacacagctcacatgctctcatgccacatgctggctgctctgcgctgggtcagcccttcagatgtttgcagaagggtgtgcttaggactcgccaggcctgtaggcagcagaaaccaactcaagccaggaaagggccctcttggaactgaaattaataatactcgcccaactgggcgccgtggctttcgcctgtaatcccagcactttgggaggccaagtcatgaggatcacttgagctcaggaattcaagaccagcctgggtgacagagagagacctgcctaaaacaacaacaaaaaataatttaaaaaatataataattaaaaaataataaaattaataacagtacttgccccataggggtattgtgaggcctcaatgggccaggatgtgtagtatttacggctgtgcatggcacagaagaggaagtcagtacatgttagctgccatcctccaccctcctccccatgaaacactcatccatgttctcatctgcatgcatgagggcagctctctcctgcccacacccccacactgtcaccatgggggccacacatcctgctgtgtcgtgggctggaccggaatcctcacctcaggcttctgcttctggcctcaggaccttgtggtgcctacttccgctgccagaatggcaggtgcatcccctcaagcctcgtgtgtgacccctggggcatggacaactgtggcgatggcagtgaccagggctcctggtcaccagctgactgcagaggtcagtgcggggtgtggactgggccctactgaacagctggagggaagcctggccctaactccccttccctagggcagggccccgatggggaggcaggagagaggaaagcggaagtgtggaatcggcttaggccaagggctggaggggcagagcagtcagggccagaactatgctgcagatgatctcatccggcggattccaaatgatgctttagtggtggaaacttttgctaaatgggacctggcatggaggcccaagacattcaaaggagatatcctctgcttaactggatggtgggcctggggccctggctgcctgatgtctctctgagggccctgagtgtcaccctcaagacatactttgaaaaccatcaatccagtctgattcccacactttacagatcaggaaactgaggcctagagagaagtgacttgcccaaggtcataaagccagtgagtaaaatgagcaggaatgatctctgtagacaggggagtgggataggagggctagggttggtggaagggaccagaacaaatcacccaggaataaccttcctggggatctaaagatgtcccacctgcccaccacacccaattaggagtgggatggaggtagggctgccatgtacagttgaacaggggtgaaatgcagtttcccagaaccccacacacttaccttccccatcccccgctcagccttttttgcaggttcctggtcatttccctgatgctgtatgctttgtgccatgagacccaggtcctatgtccccttgtcctccatccaggctcattcccttgtgggtctcatttatatcgtatcacctgtgggacttgtctttgaacttcagccacataacctcctccctgctcagcatctctgcgtggatgtataggcgaaatctcaaacttaacttgccccatactggactccttgtccacagccctccctgcatcctgcttccctctcgctgagcagcgacttcacattccagctgcccaggcctcactgagtcatcttttactccccgcttaacccatagcctataacccataaccaagccagtgacaagtcctttgaaagctctccagactctgacccttctcacacctgctctgccatcacctggtctgagccaccaccagctctcgtctgggttgttctaataacttctgaactggtctccctccttctgtcctttgcctctgacaacacaggaagaaggaagcctgggggagccttctttttctttttctttttttcaaatgaacttacttatttattgttttgagataggttctcattctgttatccaggctggagtgcagtggcgccatctcggctcactgcaacctctgcttcctgggctcaggtgatcctcccacctcagcccccagagtagctgggaccacacatgcaccaccatgcccagctaatttttgtgttttctgtagagatgaggtctcactgtattgcaagggctagtctcgaactcctggactcaagatcttcccaccttggcctcccaaagtgctgggattgcatgaacttcattttttagggcagttttagatttacaaaaaaattgagaagatagtacagaaaattctcatatacccagcactcagtttgggtgctattactgacattttacattagtatgagacatttgttttaattaatgaagtaatattattaactaaagtccacagtttgttcagttttccctagtttttacctcatgtcctttttctgtcccgggatcccactcagcatctcatgttacatttatttatttatttattttattactttttttcagatagagtcttgctctgtcgcctaggctagacagactgcagtggcgtgatctcggctcactgcaacctctgcctccctggttcaagcgattctcctgcctcagcctccggtgtagctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggcgtgagcctccgcacccggcctcatgttacattcattaatagtcatcatgcctctttaggctccccttggctgtggcagtttctcaggatttccttgtttttaatgatcttgacagttgtgagtactgctcagggattttgtaggatgccccactattgggatttatttgatacttttctcatgaaaagactagagttacagttcacagaggtgaaatgccatcttcatcacatcacatcacaccaaacatgactttggtgttgggtgtttggtgttggacggtggttgacgctgaccttgaccgcctggctgatgtctgcctcatttctccaccgttacttttggtcccatctttccccactgtattcttgggaagtcactatgtatagcccacttgagtggggagttatgcttccccgccagaggtaccttttaaaacagtaaatcaggttatgtcactatcctgctcaaaaccctcatcacattcagcaaaggcaaagcctcgcccgggctcaaaggccctgcacgatctggccctgccccttctttcctggcctcgcctcttccttcctggccccgccccccgccccacccctccctggccccgcctcctccctgccccaccccctccctggccccgcctcccctccacactccagctttgttctggcctttgcagtagctgtgtcctctaccagaagacttttcttctgagatctgcattgcaagctcgttcctttgcttcctggtgggtctctttaagttcttccctgactcctttatataaaaatagcaaccctggccaggtgcggtggctcacgcctgtaatcccagcactttgggaggccgaggtgggcggatcacctgtagtcgggagttcgagaccaacctgaccaacatggagaaaccccatctgtactaaaaatacaaaattagctgggcgtggtggcatatgcctgtagtcccagctacttgggaggctaaggcaggagaatcacttgaacccgggaggcataggttgcggtgagccgagatcgcacggttgcactccagcttgagcaacaagagcgaaactgtctcaaaaaaaaagttattattagtaacttattattatattctaatatgtatattagatatgcttcctgtacagcctgcagaactgagacaattaaacctcttttctttataaattacctttataaatttataaatttataaattacctttctttataaatttataagaaaattataaattttctttataagcatatacatatgtatattagaatagtcaaaatcacagagacaggaagtagagccatggtcactaggggctgggggggtggggacaaggaggatatggagttaatggaattgacggagttgatggagtttccgtttgggcagatacaaagttctggagatggatggcggtgatggctgcacaatgtgagtgcgtattagtccattctcgcattgctataaaaaaacacctgagactgggtactttataaagaaaagaggtttaattatctcacagttctgcaggctatacaggaagcatgatgctggcatctgctcagcttcaggggatgcctcaagaaacttacaatcttggcagaaggcgaggggagcaggcacagccagagtaggagcaagagagagtgagtggggaggcactgcacacttttaaacaaccagatcttgagagaactcactatcttgagaacagcaccaaacggatggtgctaaactattcatgagaaatccacccccatgatctaatcacttcctaccaggccccacctccaacactgggaattacaatttgacctgagatttgggtgggaacacagatccaaactctatcagaatatatttaatgccactgaactgtacccctaaccatggttaaatggtaaacgttatgtgctttgccacagtaagaaaagcggcagcccgctgggcgcggtggctcacgcctgtaatcccagcactttgggaggcagaggcgggaggatcacgaggtcaggagatcgagaccacagtgaaaccccgtctctactaaaaatacaaaaaattagctgggcgcagtggcgggcacctgtagtcccggctactcgggaggctgaggcaggagaatggcgtgaacccggaaggcggagcttgcagtgagccgagatcctgccactgcactccagcctgggcgacagagcgagactccgtctcaaaaaaaaaaaaaaaaaaagaaaagaaaagaaaagcggcagccctgcccccaccaacatgcgtaatttttctcactagcatctatctcctttagacataaattctattcatgtgttttgtttctccccacactaaactcccagtgccatgaagacatatttgtcatgtgctcatggttgtatcccccagttgctagagccatgcctgggggcataggagatgctcaagaaatactagtcaaatgaatggaagaaggaacctctatgcctcagtttccttatctgtgaaatggggataaacctcacccttcagagttgttgtaaactgtgagtggcatacataggtaacgggcccagcacagagtgtggtgcttgatgcacagaaaatgctcatggccgggcatggtggctcacgcctggaatcccagcattttgggaggctgaggcaggtggattgcttgagctcaggagtcgagaccagcttgggcaacatagtgagatcccgtctctacaaaaaatagaaaaattagccaggcatggtggcacgtgctggtagtcccagctactcgggaggctgaggtaggaggatcacttgagcctgggaggcagaagttgcagtgagtggtgattgcgccactggactccagcctgggcgacagagtgagaccctgcctcaatgctcagtacatgtacaccctcttccttgggaagtagctccactcatagaccttaggccctggagccagaccatgtgagttcaagtcctcctatcacttccagctaattgaactcggcaagtgacaacctctctgtaaaatggaaacacagagtgacaaactcagggaagtcttgtgaggattgaatgaaacacacaagtgtcccagaaagggcagttctcagtgtgctagttctgttctttcccatgcaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggttacaccttgctcctactcttcccaccaaaatcatacctgtccctctctaggtgatggggacggggcagaggacccaggccgaggcctgagtggactttctcttcccacaggcccccagctctgaggggtggcgctggcctcctcgatgctcctggcctctgctggcctcctcctgggcctcctctggtgctgttgctctcccagctggctggcctggcaacctggtgcccgtggcctctgcctccactgcagcacagcctgtaccacgtgctacccatgtcccagccaggtctccccagggggctgcagttgagtggcccagccttataggatcagggaggccatccctagaggggcttcgggcacatgggaatgatactaggctctggggtcagactctttgggttctaaccccctggctctctgtctgatgttggacaggccccctaaccctctgagactcagctgcccctctagaaaataggacaattcctgcctcacagggttgggggcctgggggcctcgctgatcccaagccagcttgcttcacccccagatctcacctgccctgctctgccccatccacaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtgagtcctgccttcccccacctaaggcactagctcttcctgagcaccagcggcatccgtccgtccgttgtctgttggaggagtccctgggccttcacttccagatgggtggggatgtggcctggggtgggcggggcccggtgggcggggccctatcagtgctgggctctgcctgtagcagctcctggtaagagttggggtgggccttcccttacagcccctgagggagggaccccaggctgtgtgctggcaggagggggtgggaatgcaggccaggaggacgtggtaggagggggagtctgccagaggaggtgccaggggctgggtggaggtgggtgggggtgctgaaaaacgagctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctggggcgtggcccgggagtccgtgtggggcaggcaggtgcctacgaggggcaggggcgtgtgttggccccggcctgggcgcggtgctgcaggtccaggggctgtgggggcggggcgccgggtcgggccgagtgcagcaccaggttcttgacacagcctgtgatgcctgaggagaatctgcccccggtcagcgtggccacgtcaggggctccgcctgccgggaggtgagaggacagggcctgtgggctccagcagcccaggaggcgaggaaggctgggcgagctctagccctaagggagtgccgttcctgcccctgccctgagaaggagccccagacttaccgatgtagacgctgcccttggcgttgactgccacgttgggacctggggaccggccgctgaccagctcctcaccgtcgacttggatggaacctctgcggccctccctgcagtggaactgggtcaggcccctttccacaaacttcctggtcctccccggccccacgacagagtcccctccctctgatatcgagactccagactcagaagtctgtccctgtttcccaagctctttctttcccccgctgaacgagagatcgggccccacaaacacagcttcctcatttctgcacccaggtttcctcccactcctggggcactcgcctgcccccagcggagttcagtccgagatggaagcccgagccctggctggtgggttctcccctcccctggcttcaagttctgtctccacagagctcaatacctgcctctctgcccatggtagggggcgtcctgccccactccagaacgctgggccccatcccgagtgcccggcagggtcccttaccgcagtgctgtcacccggtgccactcgccgtcattgatggggtcctcagagaccaggcgggcctccccactacccagctggtacctgcagtcatccaggcccaagaagtatgagctggggcaggaccggggggtggggtgctgggaccagggaagggagaggaagggccaggtgccaggacctacctgaagacaaggtgcccgtcttgaagcccgaggctgatgaagtccttgccttggccggcctctcccacctcctgccagggaagcacagggtctctggggtccccagcctggagagcagaggctgccgaggccagggggctctgctttcccctccccccaccactccggccaccaggaagccagcttcctgccccaggagccccaagagcccagccggatacccacactcaccacaccctgccagagcaggaggccactggctgtgctggtccgaacctccagctcgatggtctcgggcacctcgggcaggctgcggaggaagagcgggtgaggggacagaagtcccagattcccatcctccccattaggcccatgggcccttccaatgccagtctcacctcctggagaagacatggccagggaaggcgaggaagccatcatcgtggaaataggctccgtactgcccaggggcatctgtgggagagaggagggtggtgccatacctgctgcatcaggcatcaaaatcccccgtcagttcccctgacccccacctccacgccaacatgcaggactagggggctccgagcctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagcaagtcaggaaacttaaaacatgttttgattactttacttcagcataattgctttccttaaatcaatgtattttattttattttattttgtgtagtcaacaggatccgtgtcgggtgacccgccattctacttgccaaattctgtctggctttagccctgaaagtcccacatcccaagaaacccctcagtccggagctactgggaccgttggtcaccttggactgtggcaataaatggttcagagccttggtgttctctccatcttacagaagagcaggcaggcttgggcgagtgactggcccaggatgtccatactgtgtgtggctccacacccccccagccctatctgctcatgacccatcccacaggccggcactggccacagtagctctggcaggggacaagagtaggggaccctctgctaccctccaccaaatgatgaggagaacggctgacatttacctaacacctatgatgtggctgtgcggggagcgtcccatccagctacagacaccactgcatttaactcaatccttacaacaaccctatgaatgaatattatatatagataatttttattttatttatttatttttgagatggagtctcgctccgtggcccaggctggagtgcagtggcacaatcttggttcactacaacccccacctcccaggttcaagcaattctcctgccttggcctcccgagtagctgggactacaggtgtgcaccaccacacctggctaatttttgtatttttagtagagatggggtttcgccatgttggccaggctggtctcgaactgatctcaggtgatccacccaccttgtcctcccaaagtgctgggatgacaggtgtgagccaccgcacccagccttattttttatttttttgagacagggtctcagtctgttgcccaggctagagtgcagtgacacaattgtagctcactacagcctcgacctcctgggctcaagtgatccttctgcctcagctgggaccatagccatgtgccaccacacccagctaattcttaaatttcttgtagagatgaggtctccctgtgttgcccaggttgatcttgaactcctgggctcaagcaatcctcctgcctgtctcctgagtagctgggaccatagatgagcaccaccatgcccagctactttttgtatttttttgtagagacaggatttcgccttgttgcccaggctggtctggaactcctgggctcaagcaatctgcccgccacagcctcccaaagtgctgggattataggcgtgagtcaccatacccagctgaatatagtatttttttttgagagggagtttcgctcttgttgcccaggctggagtgcaatggtgcatgcaatcttggctcatggcaacctccacctcccaggttcaagcgattctcctgcctcagcctccggagtagctgggattataggcatgtgccaccacgcccagctaattttgtatttttagtagagatggggtttctccatgttggtcaggctggtctcaaattcccaacctcaggtgatctgcccgcttcagcttcctaaagtgctgggattacaggcgtgagccagtgtgcccggccagctgaacataatattaacaacagctaacattctgtactgactctgtaccacacattgttctaggcatttaaaatgcactaagtggccgggcgcggtggcttatgcctgtaatccagcactttaggacggtggcttacgcctgtaatccagcactttaggaagccaaggggggcggatcacctgaggtcaggagttagagacaggcctggccaacatggtgaaaccccatccctacaaaaaatacaaaaattagcggggtgtggtggcaggcacctgtaatcccagctactcaggaagctgaggcagcagaatcgcttgagtctgggaggcgggggttgcagtgagccgagattgtgccactgcactccagcctgggtgaaagagcaagactccaccttaaaaaaaaatgcactaagtaattttactctcacataaaattttatccaaatctttagggaaagatgttactcatctccattttatatgaggcacagagaggttaagcgactcacccaaagttccacagctagtaagtgggagagctaggatttgaacccaagcaggctggctccaagtctatactcttacccactataccactgcctcgcctattatattagtgatacataagaagagatgtgtctgtaaaggggttagcacagtgtccgtaaacattcaatcagcattcactcttcactgtttccttagcttttcagtagacggtggaattcttgggaatgagggtcttgctttatgcatcttatatttactgctctcagggcaaggatgggcaacaatagtttgttgactgaatacatgaatacagaggaggaaactgaggtcagagtggtttcaaaggcctgcccaaggtcacccagccagtaagtgtggggcaggccctagctccacatggctgtggtcttcattctgtctctctgcccagcaagctcctcatataaagctgttttgcttgcaggccagaattgagggtgtggggtaactggaagagtgagctgagctgaagctggggaggaggccatggcaagtactcaccattgcccccgctgccttcaagatgccagtcggactctgctatgccatgtccagagcctatggagaagggcagggtccagttggtgggcatagacacccgtgggtactatgtcgagctccggggccccaagacagagatgaagtggagagaagccaggcctgggtaccttgttggcagcgtgggccagagaagccagggaggcagaggcagcgggtgccctggcaggtgcccccatgcagacagggttcacggagctggcaggggttctcctcgtgctcacacaggtctcctgtgggccagggcagaggcgagtgggtgggtgggcatgggctggaggtgtcgctgaccacctgtgcccctcccctccggtgccctgggcaggctttcccacctttgaatccatctcgacacaggcactggaactcatactcgccagcgggcatgcacgtggcaccatgttggcaaggctggcgctcacatggggagctatcatagcattgcccgatgccctggctgcctaggaaactgtaggtgaggtccagccgtttgccattcactgacacctgtggggacagggacaccgagggactaaaggggcctgggaggcagagacccaggtgtaccagcagggagaagaatgcagcagaggggagctgggagcccacattgggccctgagtggtagcatggattctcggtgtggggagggaggcgcaggagttgagtgcctactgtgtgctagaaacattcatccgtcagtgcagacaatcctctgcccaacctttcaaagtaggtgtgatcatgcccattttacagaggaggaaactgaggctcagaggtacagtgtcctggcccagggcccgtgggtggctgcaggtggaggggcccaatgccaaggtgcttggagagccgagggggacacaaggcttggcacccctcccctcccgcttgtcccgaggaggctgctcttacctcgcccacacagccgcggaagtgagcgctcatgttggtggccggggacagtggcacggaaggctccacaccccccaggtagagcagggtgtgcaggttgaggccctggctcttgccgggcgaggagcgcagcacagggcgtccaccattcacccgcaggctgccgtccttgttgagacgctctgcagacacacggtgccagcggcccagggccagcggctcggcgctccgcagaacggccagccctggggaggatgccaggcagggttgggcacatgggggcacacggggctccctgccctctccaccacaaacagggccctgagcagatggggaatgccctacagccttctgtattccagatgaggagcccatggctcagagagggctagggattggcctcaagtgacacagagacgaaatgcacaggaagaggggacttgccctgatccctgcatttatcctcccatgcctccctggggcttgaagagccgaggggggcacaaggcttggtgtgcagagccccgcatttggtgctgggtgcttacctgaccccaactcatagcggaactccaggtggccgcccaccatcgccagggacacgaagtcctccacaggcccgctcttccccccgctgaacagcaggaccccgtcaggggcgagtggcttgaactccacgtccaggcgtagctcgtggtgtgtgttggtgagggcgggcagtgccaggtaggagccagcacccgacagcgagggggtggtcactgtcacacctgcagcagccacagctcagctgaggcagtggggatcctggaccctcgggtggggtccagctactctgccttcctctgggacccttgcctgcctcactctccaggcccagaggctcaggaccagttggcaccagctgcagtggcacaggagcccccctgcccttgcacacggggctgggaggagctccaatatgacaggggtcctctttgggggccctcactcaataaggggctcaggctgggcagacatgtggccaggtgacttcgagatcctctggcttgggaatcgttttatcatccgtagggcccatcatggcctcagagtgccccacccagcctccccagctgacactaggaccctgggggtctcaggcctggctcccctcaccttcctcacaccgcaaccccgagcggcccaggtggcagcggcaggtgtagcctcgaccgtcaggccggttcacacaggtggcgtcgggcccacaggcctctggggggcacataggccagtgaaaagacacggaggtgactctggagggaggggggtcctgatgccagaggtctgcccatcacaccccggggggctgggctagtgagggccaggccagcctcctgggaggccttggaggagggaactgagcagagcaaggcgggagccagaagaggccacagggaggactgcaggggaagcagtcgagggactctgtgtgtctgcaggttcttcagagactggacagtgttggagggggagcacctggtggcgggtaatggggtgggcacctgggtaataagatgggactgggggccgggcgtgggggctcatgcctgtaatcccagcactttgggaggccgaggtgggtggatcacctgaggtcaggagttcaagaccagccatggccaacgtagtgaaaccccgcctctactaaaaatgcaaaaaatttagccaggggtggtggcagacacttgtattcccagctactcaggaggctgaggcaggagaatcgcttgaacccgggaggtggaagttgcagtgagctgagatcgtgccactgcactccagcctgggcaacaagagcgaaacttcgtctcaaaaaaaaaaaaaaaaaaaaaagatgggctgggggtgggggagtgcctgggtggcggggtagtggtaagaatttggtcagcagggctggaggaggggaagcagcagtgatggggtgagggccttcgggtagcagagatgggggatgggtacatgggaggagtggagagtgctcaggtgagagtggggggtgtggaagtgccccagtggttgagatggtggtggatatggggaggcagcaaagggaagaggcaggccctggggcgacagcgactggcggtcggggtgcgtacctggatggcagtgcagggcctgcgagtgctcacagcggctcccggtgaagccagctgggcagacgcacacgtagctgctgctctcagagtcatggcactgaccgccattctgcaaagcagcccccagaagtaaggccgagaacattcagtaccccccataatccccacaggggccagccatggctaggggtggaggccacggcagccaggtggtgtgtggggtgtggggtcacctggcagggccggtcccgacaggtggggcagtgggagatgccgtgcgccgtgaggttgaggtcatggaagacgatctcctcgccctggatgcgcagctcccggacacagcctgggaggtgagtgggcaggatgagcacagggcagggtgtcccagcccataccctgaggtgccctcccaggctctccagggctcttccagccagccaggtaaggcccagcctcagctggaggtggggagggggctcacctatgaagccgctgctcagccccgccttggggatggcaccatagtcaggatagccacccaggtagagttcctcgttcagatccaggccctggaacttgccctggggaggtggggaagtcaggaatggcaacagaggctgggcaagggcgggatgagggctggaagtagcagtatggggttgggtctcacctgggaggtcccattgaccggggccaggtcacccacaatcagggagccctgggtgaggctgcgcagcagggtcacggtgtggaaatggcccagggccagtggtgtgggatggcggatggtggccatgcctgagcctgcatcgaacctgctccgtggggcaggccggggcaggagagagtggatagggggtttgtaagaagggctaggggcccagttgggtagaggggtcccagaggagggatgtcaccacttcctgcagtcccagccctggggctgttcccgttcctgtccctgtcttgtcgtccctccccgtgacccatcccctggatcttctctccccacatccttttgctgggagctttcccagagcagcccacagggaccccaggctcagcgccctgcagcctagcacctggcctccttgttcctctgaggactcctctctccctgtgatcaccttgtttctctgtttatggcttgtttattcttccccagtgagaatacacctcttcccacaagagccagaatttggtctgttttgttttacctgtatcagtgcctggcacacatggggtggtcagcaaataactgatgcatgcatgcatgaatgaatgaatgaatgaatgaatcctggcctgcagcagtcccaagtctgaggttgcaccctcctccacctgactggcatactattcctactctagcagattgggtggtcaccaagggtaacggccacattttctccttcctccagatctcctttgtataatggagcccagggtagcacttgccagaccaaagccctgtgtccagtccccctgtaggtggggaggctgggggtctcaccggaactcgggccttccccccacgaggccgaaggagatgaagtcgggctgccggttggccaggttggtggggctccctgggactcgcttctgcccattgtacagcagcatccctgggtgggcaccactgtgtaaggggcccccttccagccacaggctccctgtcctcccccaccctagaaaccacccaagctcttgagcctgtccactctcggaacctgtccctccctctggcactcctcacacagccagggccttctcactatctcagggctggtgccccaaacgcaagggccttactgagcgcccctagaaagaaactgaatttgcttcacacacactggagtctccctcaagggggagagggaggcagagactcacccgagtagagaaggaggcctggacagtgaaagtcagagacccgtaagagacgagagaaagagaggaggaaagggtgagatggaggcagaggagggaggaaggagcagagatggggaaaggaagctgggacaggaggactgggggtgatgccccggtggcagaggagccacgaggaggctggagatatcacagaggcagggatggagaagccgggaggcacaagagaaggcacaccagggtggaggcccagaggtctgggggcttctggagagggagggctgagggattggggcaggactgaggggcagccagggctcctgccatgatggcagttactccacgaggtccctcaacccaggccagcccaccccgcaaattaaccctcctgctcaccatcggctgagtcgggccggaaggtgatcttgatctcgaacttcctgtaggcatccttgatggtgggcagcggtaggaaggagtagggggtctgcgtgaagtagggcaccacccgctctgccagcagagagcacagctgaagaccctgccagtcagggagtgggcagggcactgccaattcttaggggtggtgtcttacctggcacctgcaggtgggcaaaggctttgaccttgccctggcggttagtggcggtgcagacgtaggtacctgcgtcctggggtcggactgagggcagcatcagcatgttgttctccaggcggctgtcaggtggcaggctgccatccagctgcaaatgcactagcactgagggccctggccttggcccacggctccaggggcccacctcccatctgtgcctcaggcccaccttccaacattgagcgtttgctcttggccaagcctgtgccacatcctggggacactgagacgcttcagatctgttcccagcccccaagtcatgcccgctggttccctctccagcacttaccttgctccagctgatgtcaggagtggggtagcctgaggctatgcaggggaagacagctgcagaaccagcaggcacacggacttcttggggcattgagatctggggcaaggctgagaggcatggaagagacataggccatcaacatgacagtcacagatatgtgcccagcctgcaccctgattcatttcatcttcacaccaccccttgaaggaagccactacattccatttcacagatgaggaaattatggctcagaggggaaaagcggctgtttgctcctggtcgggcagagtcagggttcagggccagatccatttcactccacagcctgagacctcttcaacatgcctgggcaaaaaattgtgcagccctttggggacctgagaagtgcacactaggggcagtataggtaaggaagtttggaggcaagtcacagggcttggggtaaaaaggaattgcctttaaagaacacacagtgtttgtgtctgccctgcatctgttgtccttgttttactctctattaggtctgtttgttgactgggttatgtctctgccctcagactatgctgcaggtctctcccagcagagcaggcactccctgcagatgaggacaaggtttcttttttcttcttgatgctctatggcctagctctctccctgtacattccaggctgccctgggggaatctcacttttatcccctgctgctgccacctgttatgaaacctgccccttaaacacacacaatggaaaatgtcccaagtgaacagaaaggaagagcagagcgggcaggcagaagatggcagcaggagaagcccctgccccactcactgtcccccaacaaaagtccccactggccttcaccttgcacaagcagcaggacgtgggattgtgtggtgccagctgcgttggtggcagtgcagcgatactgtcccgcatcagccagctctacgtgggcgatcctgacgacacctccgctctgcacaatgcctggccgcaggtgccctccaactttgctccatgtcacctgaggcttggggtcacccagtgccaggcattcgaactccacggcgtggccaaccaccacggtctgcacagaggtccggatgttgatgagcaccgagggcagggctggggaggagggaggcagaggtccagtgagatcagtcactgcaggcctggcccgagggaggccatagactgcccaaggaaaggtgagcactgaagctccagcattcattcactcctcattcactttttcatgcattcactcacaaacacactcacttgtcaggtcttatgcatttactcactcacgtgtccacttcttttttttttttagacaaagggtcttggttgtattcacaggtgtgatcacggctcaccacagcctagaattcatgcgct

SEQ ID NO: 1129 - DNA, 140432 bp, Homo sapiens
taagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttcactttgtgccccaatctcctgtctttgggaagctttgatggccaggatcctttctcccagaggaatcatggttatcatcatcatcatcatcatcatccactcctagacacataatcttatatgagtgcagtccggagaaaggccacatggtagaaagtgggtcctccacttcccagacacccttgcctcaacacctcttcctttgatactgctggggccagtgcttcccaagatgtcatggagttgcttttacaggccattttgatggattccctccagccatacatatcattgtgatcttaggccattcagctgaattgaagctagaagagctgttgctaatgagttgttgttccacgaaagtgttatccagagaaaaatgcaatgacccagggatgcaggcctgggagtagaaccatttgcctctgggtgggaagcagatgaggctaaggggagaagagtgacgtgatgacagggtcaggggagtagggatctgacaggtgagagagcagcagagtggagggacccaggaggagctggtgacctgggaggctcagggtcagaggacagggtaagagacagtgtatcccatgtgggctcctgggtgtcctgttgtctctctatgtgtatctgctgtcatggccacaataatgctgcataacaaaaatcacaaaactgcaatggcatgcagcaacgagtgtttattcctcatgcgccttaagtggtcagcttggcagctctgccagtcttggttgggcttgactaggtggatcttccggtgtccgttggacttgctcacacgtgtcagggttgctaattcaggacagccttggctgggttggtgaggtggcttgtgtctgctccgtgtgtttcttgtcctcctcctgggctaatgggctggcctgagcatgcccttctcctaacaatgggggagggcacgagcacgagagtaaaggtggaaggcctttcacagcctcggcttggcactgccacaccccagtcatctgtggattcaagagaggaagaaacgggccggcccccacgtgacatatgggctcttctccagcatgagagaactaccaagctgcccggtggagggcatggactcaggagcagtggaaaagcgtcactgctgatgcaatcggtctaccccagcaagtcctacgtcattcacagcagggtgcagtagggaggccgtgaccccctggccataggtcttctccgaccttctttaacccttggggctggaggcgaggtccatgatgttctcagtgcccagccaggccaggcctgatgcgagcagcacccgccctcccccatcgcaatgcggtgccctctcttccccttgccctccttccacatgctccctgacacttggcagctggccccgttgctgttctgaggaggagggactggaccggctggaagatgggatctgtgcctggcttttgggtagccgctgtggggagagcatgttgaaggctggccaggctcttggctgaagagaaaggtttggggtgtcgccagggagctcagaggctaacagcagtccctgtcctagggaggaaggatggagtggggcacgggatcctgaaaagcttttctcccacaatcagggtctgaggaaattccccggaacctcccacatgttcgaagcaagggtgaccgggtgtggggtgaggatgtccttgcttttcctattaagatggcctcccataaccctgcatgttcctggaggccccacctcaggatttctctcaggaaggtctgtgggggtcttctgtgtcccccttctgcggctgcccaggcagctgccccggcctgcccgccgctctgaaggccgtgccactctcccaccctggtatttgtctttcatttcctgacccagtcctgctcccttctcccggccctccaacacaaacaggccggctggtgtccacacacagactgccctgctggcacgggcactggcgctttcctgctgctgccccctctccttcctccctgcccacctcctcccctggccctgcaggagctgctaccccctccctgcgtgggaggaaggagctcggaaaagcgcccggagttggagctggcaggcccagggctttccacttggaggaaacgctgcatttttcacctttaacccagaaaaatatggttctcagaaagcttgtttttagcactgtgagttcccaaaggaggaagaataggcagtaggggggcccccagcctctctgagctccgacagcaacccccaccccagaaggccgttcttcctgggagggaatgaccgaggggcagcctgcagaggcccagctccgagaaaataaaggcagagaattccagctccaagcggaaagacaatactttaggagaggagcctggacaaggcatgagccgcttcccacctcctccctgcctcttccagctcctgcccagtccaggaacgcatagtagttgcccttggagctgggggtcagtccgggcgtgcccaccaccgcccagacccttagctgagaagggggtaagattagcttatcaaaggcgggaacgacgttctccagcactttctccctgcagtggggagagagctgccagcatggaatcaaaattagaatctgaaatcaggggtcgtacagctttagcccactcccacgttatttgtcaacatggagatgtgggtcgtccgacggtatccgaactagggacttatccggcacacgctaaacagagaagggaaatgtaagcagccctacctcaaccattgtgaggccagaagtcccagggctgccggcatttaagctggtgggtcccgtggaagtgacaggctgccgtaaggaagttccagcttacaggtggctatgttcgggccagcaaaatgactaatccaatgcaacagcatcagctggcttctgggctaggccctgtgagtaaccgcaccgcaacctcacagtcaaagaatgttcacatatttgatcttcataacagtcctcctcctatgatggctggagcagatgggcatggcctatttgacttaggaagacagacactggccacaaagactgggtgacttgcccatggtcccatcacgaggacgcagccacgatgctgtcccgtggagcttttctgccctcaccctgacctctggtcaggtgcagtctgcccagggacacccgcattgttgagggacattctgaggctcccttgggttagctgtcgtctgcagtatagtcgtgtaagtgagggagattcggacaaaggccatgtcccaagagtctgcttgccaacgcatgccagtttctcatcacagccctgaatctgccttctttcaaaggccttctgttgcagggactctgggttgagcaaatctgaaagcagaaactaaagagctagtccagcagggtgggattcaggcccctctacgggcaactgggtgtaggttaaattcttttcccttccctcctttgctttcatctccacaaataacctccataaccctggggagtggttgcaagctatttctgcccagcagcgtgttcccctgggcccctgcctcgccccagccaagccacgagctgaaagaacagggaaggcagctgggaaaggcctcccctgccgctcctcttcttcccgcttgctcttgctgaggcatctttgtcctagaaagttcgtagctcccaggagcacttgccatttcctggaaagacgggagagagaacattatgtctcagcccctgggaggatgtctcttcttttctatttatccatcttgtctttcagttttgctcaagatgcaaatggtgtccagaggcatagaaatttcccagcatgtggcatggcctcccccgatgtcccagctgctcacctacaagccagggcccagcccggggctatgacctccccgaacagcctgctgccaaggggctgcagttctgacttggctaggagaggacttgagttggaatgtctcttcgaaggaaggccagggaggctcaagaaatttgccgtttatactcacttaataacaaaagtaagaggcaccaggccaggggcttagctaaggaaagccctgttaggaaattggccaaaagaaagcggaggcagagaaaatggactatgaggcagagagagctgtgggaggagaggggtatggggccgcaggggtcgcaaggctcagtgcgtggtgacttccggccctgccggtagcattccatgttctcactgaacgtggggttcagagagcaactgtgggggttcagaatgaaatggggggccctgtctaatacagtggaaagtggaacacaagccgattgcttgtccaggtcacattcacaccacctcagaaatgaaagaagcctgggcgatctctgttccagctccacacggggctagagaggtaagaggatgtgcccaaggctgggggccttatccatgtgactgcctctggcctggaagctgggagcccttgggagtgggttgggaggctttgggggtggggaatggagggtgaggagcggatggcctgcgggccctcgcaaggattactgtagttgccccctccaggcactcgcccacacaaggtcggttgacatttcattgacactcactgaggacgagctattcacaaaccagcccctggccaaagtgccagtgaggatataaaggatagagaggactcagctccccctgtcaaggtgtcgcctgggctgtggtctcacctgaggctcacttgctctttgtttcttcaaagccaggggagactttctttaggcagggcccagtccctctcataagaggtctcctcaataggtcgcccacccaggatcatcgcctattaactccaagtcaactgataagtagcctaattatgggagtgacaacacaccatttccacagttccatgcaagcatctcgggggccttcgtagagtcctgcctaccacaaccctgatcaactctaactttcagtctctcccacctccagatgatacctccccaaaaaccaagttcattttcctaaaatgcaccctctgtcctgtgccatcccaactaaaggctatgccacggtcagctgtgtccctaaacaatgagtcaaacactcataagataaggggagttctgttctcagagagcataaccgtacttaaaaattcctatttatagttcctgaaaatcctgtgttcctggggtccagggaccctttgccatgactaaggacctaggctggggtacagttgatggtgtgggtgcccagggggattgaggaaattgtcaggcagctgccctttccagtggccactcagcatgaccccaagcagcccacaacttagaggaaatagcagggaatccatggaactctgcatcagcatctttggtagccagttacttataaaagacagtattttatgacacagaaaagttggtttgggtgtttttgtgtataaggtgccaatggcttttagtatgaaattcagatgtcaaactaatgccaaacacttttgcttgactttcaaagttatccattatttaatgaaaagtatgaatatagaaaaatgtccagaatacagaatagttcatccatacattgggatttcatatatccatgaaagagtaccatatatgaaaagattttcaaaatatgtgaaataaaaattcaagttccaaaacagaatctacaattcttttatatatgcacacatatacatatatatgaatagacatgtacatatatacacacacatattcacataggaaaatatttccgaaaggataaaaagtaaaatgttgaaaagacctaatgctgcataaaaagattgcgtgggcccagcatggtggctcacccctgtaattccagcactttgggacgctgaggcaggcagatcacgaggtcaggagttcgagaccagcctggccaacatggtgacaccccgtctctactaaaaatacaaaaaattagccgggtttggtggcatcagtctgtagtcccagctactggggaggccaaggcaggagaatcgcttgaactccgggaggcggaggttgcagtgagccgagatcacaccactgcaccccagcctgggtgacacagcgagactctgtcttggaaaaaaaaaaaaaagattgtgtgatttctttttcttttccattgattttctagtttttcttcagtgagtattttttgttctgtctactcaggatatcacctcttttggagggactcatctttctccaactcttgtgaaaatgtcctttgaatagaacctatgtccagccacaggactgaaccaggaatgagcacatgacaagccaggccagagtgctcgccagatcactgtgaggactcccctgatggcaaggccataagcttggaggagcctggaccatgggcccagctgcttgaggaggtcttgcttgagggaagaaagttttgtgtgtaaggagatacgtgttatttccgggtggaataggagactacagtggtgtggcctgaggaacatgccagggcttacctgcccacaaactagatgcctgaaatatcaaagccaagactatcttccagagaagcagatatgcagtttggggaagagggacgggggccagaatggatcacttggtcatgcaagttgtccatacaagttggaaggatatggagaacctaacccacagaaaatgaaaacaaggttcaaattggggaggagatggcagagggtggaggtgacagacaatgtgtagaaggactctaacctgttgtcacttcggataaaggccatttatctcccatctgctgttgtcaaagaggtaagaaggtaagagtaaatttctgtctagggagaataaggtaattgcattcaacacatcttaagcatctacttactacaaggcaagatggcccaaatctggggaaggagctgctttgagctactacagggagcctcccatccttgtccttaaccagggttcccttgtcttgcacagtctgagactatcccgcaagggatcaccctctgtaaaataacatatttctaataaccagggaaacacattaaaccacgtttttctcaaggcgcatttaaagaatattaatcaagcacctgagatgtggcagatcctgcactaagcttcatggatgtaagagcccgagacattgttcaattcccattcccaaatcaagcgttaggatcgtgcttggtgccgtggggacacacaggcctgggaaggcacaggactgagggcctggcgatgctggaaaaggcttctctgagccagcaaggcctaaactgggccctgcagatggaagaagtcatctaagtgaagcccttgtgttcactttgtggggacagatgccatggctcccctgcaggtcctgtgctgtgcagcttctctctgtgtaaatgggagagatgacctaaggagcagctaaacaagtgcggaggcatttatacctttaaggccttaggtgttcctgtagtttctgaagaggcatgggtaacaaacatccactgctgggaacatgatgtactctgtctaatcctccccagtcctgcaaaggtgggcatgaagagccacgtttcagagacgaggaaacggggagaggctgaataactctccaaagcttatcctgatagtgagttgtgaagctgggatgggagccaggcctgtgaagcctcccgcaaggcagcggctgactcggaaaaggtgtgaacccagcctcagccaacacaggaaaggaaaggagcgacaatggtaattgaggaaattagagtctaggttccattctgaaggtgtcatgttgcctgcactggtaattgggcaatttaggactaggagggtccatctgttctcaacactctgcttcctcaaggctttcagtccctggctcgcatcaactccaaggatggtgtaggtgaggggagtatgcaagtgcctctagagctggaagaggctcagcctcgagcagagttacggcaggctgagggcaggaaggggaataaagatttgtttgagctgaggcttgacattctttcataactttggaaggtttggagacagaggttcatacactgggattgcattcattttaatgctgtttccacttaaaaggttttttatttttttatttttatttttatttttttttggagatggagttctgctcttgttgcccagactggagtgcagtggtgtgatctcggctcactgcaacctgtacctcccagattcaagcgattctcctgcctcagcctcccgagtagctgggattacatgcacgcaccagcacgtccggctaagtttttgtatttttagagatggggtttcaccacgttggccaagctggtctcgaactcctgacctcgtgatccacccgccttggcctccaaaagtgctaggattacaggcgtgagccactgcacctggccatcacttaacagtctttctcaaggtcatcctcaaaagcttttcttgtctctaatctgaaactaatcacccagggataaaatcatctccaatttaagcacaaatcagttcaaggcatctcttgttatttcatcttccctgggaccagcacaacgaatattttcaattcagttttattgttgatcactccaggagaaagctagtaagatcaaatttataagccactaataacaagctattattatagttcttttgtgaagaacttatttgtaagctaacattttagttgacattgaatacctttaaacatttttttcatacatgtctattttttctcccaataatctcatcattcttctctgattctttttaaaagttcccggggttgagggtgctatacatcttgactcaagaactcaccatctgggaaacaagttatgcattgagaatccccaaagaacaggctatatgtatgaacttcctagcacttaaatactaacatgctttttacaattgagttggtctgcagtttcttctggttaaatccaggcccattcatgtttcaatctggctaagtctaggctatacatatgactaaggacttaatttctccatttaagaacatctatttaagatcactttatactttaaaattactggttttgctaaatctgtgactgtatttcctaatagggtgaaataaaattttgatacattctcagaatcttcaggaattttaagctattttcagaggacataaactaaaaaccattactttaaagaccagtatttattatttatttgctaatgttggattcccactatttgattattttgatgctaacttctcaggtaaacaataatgacttaatggacagatggatgttacaccaatggcacagcaatgtactcaaatgttaaaaatacatccatagcgctatgtgattgctttacaaccactgtatttcttacgggatagaacaaaaaaatacaacaacaaagcagagccacttctcctaagtgtgtaacatggggaaaaacccaataatgcccaagtctgtcagtgtaagatgtaagaaaatatatttattttttccatgacaatactatgataaaattgttaaatacatgcatgttttaaaaacagacataagtaacatctttagagttaacagccaagcatactagttttacatttatggtgttttagtaatagattattttctatgtttttgctataatcatgttttccaaaagatacagaaactaaattctgaaattatacaatgatataaagtgtccaaatttcccattctaacagcaatttaaaatccaaattttcacaaggcaggaaatgcttcagttatcatctaagtggagttgttttattccatattactctcagaattctgtgaatcagactgaatcacacacatgtacttcatctatagttttcttcctgtataagtgtattgaaatgtttccttatacgattaaacatgattttaggtacagcacatcacaactgtttattcaccttaaaaaaatgtctgtagtggtaacatttcaagaaatgaaaaagggaacagtttgggatccgcagtttctccctatcttctttcagctacatttacaagcatttgaccaaacaaaaattagtaaacagttactagtatttataaaaaacttaaaatatttaacatataatactcactttaaaaaaacattcattctacaaaccttataaaagacagaaacttatatctgttcacagtatgtgtattttgtaaacagtaattcactataatgcaattttgaaagtaaaaaaaggtaatttcctagtgttataaggaccttgacttatggccagctaatgaaagagaagaaaacctaacatccttattaggaaagttaagtattttgaaatgatttattttacctttcaacatacttttaagatggtactatcttaaatctaggatgtctatctatccaggccaatcttttgcaagcaattctgaatttaaatgtatttaagaaaaagccgtgctcttttttgagaaaataacaggataaaacaaacgccaggaagggcatcaatcacataacacctacccctccacaacaatgaaaggtttctttttcgtgttgtctcccgctactcacaatgttattcatatttttcctaaatattgtgttggaaggaaaaattaaatacaaggaaacactagcttatgatatattagacaatttggggaaaagcatttggaatcaaactgggagaagaatgttttacaaaaattgtatgaaaaccattattcagtgttcttttctatgagcaattgcaaaaacactaatactaatgttaaacctaacagttaacttttccacgttataaatgaaaattgtactaccacctagagatattttgatcttttataatacacaactggaatgtttaggaaaatagttcggaagctgaaagttacccatttaaaatggaataattcttaacggaagtacactttaaatgtataaggaaattcaacaacttaagtgagccattcaatcacgtgtgcaaagtattttagtcttaagggcaacacataggatctatgttgttagcttttttttttttaaagttctgattggctactgtaaaggcaatcttagaagatgcatgtaaatataatataaatcaactttcttatcaattagacattttccccactcacatctcttagtttttagggtattcagtcccagcaaccaaaaaaaaaaatgtaaatcatattttgtttctggctaatgttcaatcagtttttcttttataagagcttttgatgtactgtttctacggttctttaggcacttacacataaaaacattcagagggttttccccttaacacacaacttttaattctcatgaaaatgttgcacagttagaatttgtcttgcataggtaaattctgtttataacatggactctgataatccaaatattaacattcctaatatagggaaaaataagcaccattcatagctaaaaataatagaatcctgtcataacccaatatcataattacaaggatctggatatattctagaccaaatcacactccctgaaacattaccatgtacaataaagcctgaaatagccaactaattgaatgttattcttaatcctttacactggcactaaaaatagttcatctgtaataagcatgaatacgaccatgtaataattaatagcactaattgaaaaggaataaaaaaatctaaccaccatagcaaaataaggggtttaagtattattaatagccctggtacataatccataaagataaaaacgaaccaaattcaagccaagtaatttccaatgatattctaaggctaagtctaaaagatgaatgttctgtaactttggccataaatcattttcttctatgaaaattttcttctagaataaataagatgggcatgacagcatgaaacttcatttcagcaggaaataaagacttaaaataaatgctttcaagaaatagtttatcaagagaatgagttctgaatcagttaacctcacacacggacacactgttgggcagaacacatgctggctggtacaaacatgccccagttgcacacccatcaaagaagaagaaattatgaacacttaaaattatggagaaataagatatctagtgatatacaggcatgagtccttcctcagttttcactcaaaccgtggagtcacttccgaagtagatttgaatctttgagtcaatagtctcagatccacacaagctagattttggtgtgtatcacccttcaggaaaattctgttgaatctgtgacactctgggataggactcagtcaagaaaattagttactgagctttcacgatgtgcctagtctttgtagctaataatcccacattttactctgagatgcccaattttacactttcaaaataagaaaaaaggcatttcataaaatgcacacaaattttaacataattcaaaatagagaatagcaaaaataaccttagagcaaacaaaaaattttattagattatatacctgagcaatagaaaacttcgagataacattttaaaaatattgacacgttaaggagtattttactttcaaaataccataaaattgattttaaattccctttggaagaaaacatcccctagtctccttcactaaattacaaataattacccaaatataaaaaggacttgcaatgtttgttaaatatggacggcatgaagacaattaagaaactataggacttatttccaacaagaatacaatatgcatgaagttttgaaaatgtgactttttaccacagtttctgagagtgtaatagtactaaatgttctaaatgtaatctttcagatccacgagcggtgaaagtaatgctggtttggaaaatgaggttgatacttcctctcttaagcttctcagtgaatggctgcttctgtttctaagctgcaggaacaaagcacctctatcatataagcacataaacacacaactcaactatccagatactcagggccacaatctcaaatctagggctgtataaattcaacaaattgatgacctagattgcatacatgtgctaatctatgcaatatatgattcacaaggttcatctaatgttaaaagtctagctaagtctttaataatttaatattaaataaaatattaattatttaaaatggtcactcataaaagaaatgtagtcataataagccccataatgatctccattcctcgcaagggaagcttgatttgaaactggcttgtaagtgaattgacttgtaagagaggtaaaaatgtgtcttacatgaattactatcccacagatatgatggaacataatgctagtttgacaattagatttttctaaccaatgactgggctttcactgaggaaaagagggatttctcaattattttcccagttagtaagggctggagagaacacatctagcctctgcttctaactagtccttaattgtagcttccaagggagaagccacgaatctaactggacagagcacaatcagtatgagaccaccttgtaaatgcaggcatgcaaccttcattgacaaacagcgcacatttaccagtatctcagacaactgaacatgtgaccaatctccttccaacttccctcccctcttcccgtgttgttactctccctacacacacaggttggggggagtagaggtaatatcctgggatctacacaagggtctagctgtcttgaattcaatgagggaaaagaaggaaaactgctttggccccagacataaatcacattcttttaagcacacagcaacttataaggagcttgcccagacttaatagcgttactctgcttctcattaagctagtgatcctcgtgtaggggatccaaaagtaggggaaaggtgagtgatattctgcacttttttcatacagaaaaaaacaatgaagtcttggatagaacgaaaggacttaagagccccagtgatattcatcattaaccaaacaaatgagtcgttatataggttagaaagggccctggatccagatggtcacagttgaaatgcatatatattgacagacagagatcaaacaatctcttctggccttttctcattatctcaggttagcgccgtttagagcaataaacttttactgtagccacacttatccttgtcctggagagataaagtacgggattgatacatttcaacagggaacaaggcaggagttgagggcaagcagacaatgctaacagcaagctttggcagggagagaaggcagccccaggtctgatgtctggggtggaagctaagggaaggagccaaagaggatacaaaggaagacaagagaacactctttagggatggctctgattggatatatttttcattactgaacatttctatgaactattatatagttttaatatactatgtatgtacaaaatgaattgcatttcattccaaatttccacagatcataaagctcagaaatttagctgaatcctagcagttaaaatcaggattcatacacagagaacctaaatagattttgtcacttgtcactctggcttttttccacaacatggtttttaaaaagatacaatatgagcttcaaaaaaaattaattgatccattatttgcaaatacattacagaatctcagatgataaaaaacaaacaaacaaccaaaaaaaacaaacaaaaaagacatatcttattcggacacttaaaattttcaagtacttttgccttaaatatgaaaaggtaaaatacataggcaacctgagggcagggaaaatacaagatacactttttagtttttccttctgcttttccaagaaccacaatcactccagacatcgcttatgagaaacaagggtgggcagaggatgctgtgctgaaggcaatcaattctgcacagctcaccaagcaattgctgcacctgcaacacaggtatgcccatggattcagatcagtttatgacagttactaagaaacagcccttgggtaactgttcctgtaagaagcattctctctttagttttatatttaaaaatgtgaggactggatcagataatgtggcatgatgaaaagactcatgagtgggaggaacatccaccagaaggtgtcaaagatcaccactgcctgggtagccaagctcaacggcatggtctcctcaggaggaacgaaatccaatcagaactatatggacagctaacgctgctagatattgcttagtagtcatctcacatagtaagtcactggaattacatgcttatgaataatattgaatttgctcatataaagctgtcactgtatcacaaaataaaatgatttttaaaaaatgtgggtctctagtcttagaagtgtaaattttaaatattagggcaaccaactgaaataatggaagcaagcataaaagctaaaaaataatgaaaaggcttgcaaaacctatcacagcaagaaaacatgattatgatttgggctggtcagtgtcacacttgttttcaaagtttgtacccctgagacaactgtttgataaccattatacagtaggcacagaaataagcatactttatcaaacaaaacactaaatcgctgtcactacattaaaaattatattaatttttgtgaatgctgtggatagaggagaataatcttagaagttttaaaatctgtgcttggttttcatctagaaaggagtaaacgtcaggcaaataaacttcacctgttacttggacattttctccctggcctgcaaatccacttacaattccaccaagtatacacatgagaaaaccacaaacaacagaacagaaaacagttgcggcgggatttgttttacatgtacgtacaagtaggtattagccttgaaatgcttcttgaaggtagagtacatgagaattctttggcttgatcacaaagagctcccaatcttgagttttgtggattgaggattctgagtcactatactttggcttttagactacattaaaagcacatgaacactttcagtgtaacttaacatgtagtgaagttcacctcctaacaatacttcacaggatccctccaagaatgcccagtgctgatgtagcaacactagcagtaagagcttattgagatggctgactgaagtgacacggtgacactgttaatcgtttggtttgttctgaaaaaagtttgtaaaggaccaccctcctccattagatttaggagagtcttcatctttaggaggaatcaaaaattgtcgggaattaatggagcatggacttccaaatgagacaatctcactgttgctgtctatggatctaggagagtctggagacactaaattccatgtatttacattggcctgaggtctgtaacccgcagttttatctaagtcctcttctgcagctatatcttccacagtagaattaatggggaggtgcatctgtggcttatagcctgcccctcctacagggtcattttcttgttcttcttctggttttgcttgaggctgatacatcgactgaacatcaatgtaaataacctgtgcagtccctccagcttcatctgcggctgggtttggtatttcttcctcaatgatgggtggacaataggacacaaccacatggttttcaggctctgcatcagagcgatcttcaggacgctcagctactggggaaattatttctgtatcttctattttaggaaatgctgatcgagtttccagaacctcaacattatttggggtacaaggattcatttccaatgttttaagagcactgcttccctagaaataaatttaaacacagtgattaaaaatagcactaaatgccattgcaatgctcctcctataaaaagggacacatttttccccaatctgcttgtaaacaggtgtctctactactctgtatttcacacaacagcacagccacttttttcttccgtatcagtattttccttgttattaatacttgtgggagaaaaaagagcactgtataatttaaaattaataattttagaaactgagatgttttaaagtatataattttcccaatactttttaattaaaatgacatttgcatgttaaaaacttttcacaaaagattaaaaaaagaagccagcacatcaaagataaatataagaaaataaaagattacctcacagacactcttttgaaactgtaatgctttacagttttctggatttggaatatcagggtagaaggtttctttaatcctttaaataaaaaattattacagtaaatttaatagttttaagattattagataataaattaataaatcattaggcttattttgaagtatttatgaatcctttaatgcacatctgagattaaaatggaagatctttagtgtgatcattcactacagctgtctatacaatgcactgagaggttccaacttgaaaaccataaacagaattccatttctggaactataatacccatgtatctcatgaaaatggaaagcaagtaattaaaattgtggctgtgccatctagtccaaaggatctggactatgtaagaacagctgtgatcccatggcactgctttactgaggtggttaaaaaggtggtcataaaggtgataactacatgtcatgagtacactgcaggctgtgctaagaaaaaggctattaatcttgaccaaaaactaaatgcagccaaaaatgagatttgcctttaccgaggtggtcataaaagtgatagccacgtgtcacgagtacactgcaggctgtgctaagaaaaaggctattaatcttgaccgaaaactaaacgcaaccaaaaatgagatttgctcagtgtcctatcatatttttatatttatagctactaaaaagaactgtattacttgaaattcctacagaaaaaataactttgttaatgtgagtttgaaacgctgtaacttctaaactcccttcttattttgtcttttttttctttttttggtactttaatagttgggttttttttgtttttttggtttttttgagacagagtcttgcactgttgctagggtggggtgcagtggtgcaatcttgactcactgcaacctccaactccctggttcaagtgattctcctgcctcagcctcctagcctcctaagtagctgggattacaggcacgtgccactatgctcagctaattttttgtatttttagtagagacagggtttcaccatgttggccaggatggtctcgatctcctgaccttgtgatctgcctgccttggcctcccagagtgttgggattacaggcgtgagccactgcacccggcctaatagttgttttaaaaatgtgaattttggtaatgagaatatggttaccaaaatagactattctatagttctacaactattactattttgatttataagccaggattgctaaaatatgttctcttgtcataaatgatggcatttttaaggtcggtgaggactggtctaagcatgaatgcagccactggctccatacccagccaggacagctcttgccaggtgaccatgcacatggccctctctcccacggagctcccgctgacctcacctcatgtcactcattcctgtttcaccaggcacacagctcctcccactttctctgaaggtttgactctttccaatttcagggccctcaaagaaataattatctgtctgtaacattcttttccctctccttaccctttggaactgtaccgcagaccagccgtgacgggccatggccgaccagctcgcaggacgtagccccctgctggtctcctcagggtacctggttcagtcttcctagcacccactcacactctgcaagcacacacttgctggatgcctatggtttactgtccctcttcccacactgtgctccaagtctataagagccatggcttgttttgtgcaccacgatatgatatcccccttcacatggaagaggtcattcatatttgttgaataaatgagcaaatgattaaaatgaccagattttctaaataggtcaccagggcaagtgagatcttaatcattaaattatgcttaatcttgtagatagctattgccatatttcagcctataaatattttttataatagtaactgctatgactttaaattattaggaaaaatagtagaaaaaatttacacattgactctattaagacctttaaataatatgtcatgttcttaatattaaatccaacattaattctaattaaaacattttttaactaacttattacaacaaaaaagatacacttatttaatacataaactaatcttacaaatcttataatcatgcctttaagaagaaaacagcaagagtaaatgcagaactattaccattctcgtttccgatagcaaaggatacttgtcaccactccaacaatgacagccactgccactgggatgagaatggcaataattaatcccacagctgaaacgagagtattgcaaatattaaaatcgccatttttagtgtgaagtacagaatagatgtatgttagaaggtatttaggttggtaaattatttaggaaaaaaacaaaattaactgctgcagggacactgaaaaactattaaaatcaaactttcaggtattgtgataatttttatacaaatacttaaactcttccaagtagggtttctcaatcttgatacttgtgacattttaggccagacagatcttcactagaggatcaggggagacagtccttgcactactggaagtttaacagcatccatggcctctcaccgctagataccagcagtatcccccagttatgacaaccaaaaatgacacgagacagtgccaagtatctcttaggtgacaaaatcactctccgttgagaatcactgctttatagaaccatatcctcatggctctttatataagagctgtgtgtgaactccaactcaggggtagaggataagcctatgatcgaagtgaagttctttaccgcagaaagatagtcaaggccatcactcttctctcaaatttgagtgttgtgctttacaaaaaatttttttaagaatatctccttcacttttccctagatatgttagaaatcacataacagctggagcaaaatatttttaaatgttgaccgttagataaattcaatatgactttagacctctagacttcagatgtatcccaaattcattaatttcttaggtactcatttggaaataacttcaaataactgacaagaataaacatgaagtaatcttacagctttttaacccttccctctaccagccaaaaactgcaacaaaatgtgaatgttttttagaaagggcggggaggggttcctacataaaccaagaatcactagaacactacgcatgcaggatggaaagcacctcaacagcaacctgaaacttacaattttcctttgtcaccacatacatactcttctccgggcccactccaccatctgtataggctcgcaagaccaggtggtaacttgttttaccttgaagatcagcaattctcagtgtcttctgggatatgtcagtaatattcttaacttttatgtcagaacgacctatttttaaaatgaagtatgttagcactaatctctaacccgtttcaaatgcatggttacccacacctgtctcaccaactgcccttctaagtgggtctagctgaggccatcccagccaaggactctggagctgccactaccttgttcaagctctacccccacgccagtcattagctgtgtcgtatgggccccttatttaaaccactctcaagtggagtttttctactgatgaaatagaatatcatgacttaagctgtttgaagttttcacacacattctgtagcataatgcctggcacacagcaggcaatcaataatagtcccatttctgctactaaaagcatgaaaaccaccacaaccaaaagccacttaggctgagccttcccatgagtgagagtgaaagatgggatgaagcaaacctgcagatcaatagagatgactccaaaccacttagaaaaaggatcagtgtgatggggactctcaaataagactaatgagaaatcctttgggttataacttcaaaaggaagagtgaggaatcatttgaactactattttatttttaaaaatttaaccagaataatgcaggataacaggttaaaaaattaaatagtactaaatggttactaacaaaaagtgacagttctctaccagctcctcccctcgccccctacaaccactgtaaaagccatgtaatcaagtttctttgggtatttatctctatattccaaagtagcaaacttagagagatgtgacttttaactattagaccttatctacacatactttataagggcagataaagatagagctcttttacgctaccatcaccctttcccccaccacatcattcgtatagaaacatcggaacttttgatgaattcagtgtttggattactatgattatataaatatgagttactgctaagacacattgcttggtgtcatcatgtttcctatcttgttttcccattgttataactgctttttccctcatttgcttgattttctacataccagtcaataattcttcccatatcctccaatgtacactcagattttccacgtggtcaaacacaacaaaatcccaggtccacatcttctctgccctcccctccacccatcccttgcctcctgcactagactggatgccttcagggctgaggccctcctggagctccctgctctctctcccctgtggcttcctggaccggcctcacttcatttcctcattaggatgcactcttctagtagcttcttgagaaaagcaacatggggaaagtaaatgtttgcagcctcgcatgtacaaaatatctgcatttctctctcacgttggttgacagactggtggagtatcgaattttaggttgaaaataattttcattcagtattttgaagagacttctagtatctggagtgttgctgggctgtctattgccattattattcctgattgcttgcacatgacctgcttgtctctgatcatttctttcacattagctgcttggaaaattcataatgacataccttggcatagatcttttttctatttattttgctgtgtatttaatgaattctttggctctatatacagtagtccgcccattttcctcagagaataattataacaatatactgtaataaaaattacgtaaatatggtctctctctttcttaaagtatcttattgtactgaactcatctattttcagactgctttttgccaggggtaactgaaatggcagaaagcgaaaccatggtaagtgaaacagcggagaaggggatctgcttgtagttaggcccttcagttctaaggaacgttcttcaatcgacccctccgttcagaccagattgatcctcaccactcagcctccaaggcctggtctggcaggtactggagaagttccttctcaacaatgcctgactgcccacacagatttcacaatcttccactcatttaagtcatttgccccacttccacccacaaatttctgaatcttctttttcagtgttgttttgcctcttctgttctctccttgtggctttattagagtttgggggtgtttccccttctttatgctaactttagtgacccatctaccatgtctcactggaaatccagatgctagaattttaactggttcaagtgtaaaatttccaagcatgtgaggcaagtcacactaggctctggatgtttgtggaatttgatattcaggatgtccctcattcaccagcaatcatgaaggttcaggaaatgcagaacttggggaccgaaggggaggcacacactttctgcaggtgttctagggagtgactgagacagtgctcggccagcactgccataccgtggtggagttctctatttctcagacaggcattaaataattaaaatgatttctttctgaggcgaggtcatccagggacatgaaagctctcaaactgaaaagatgatatgcttgtgttatgcagctatgaataagaaatatctgattctcagcagaaacataatgaaaggaaaagccagaaatctgtacaattttgtatttgtaaatctgagaattctctaaagtctttggatgtacacttgccgatttccaaggattgtctgtactttttaatacatccccaatcaagtcaattaagttttccagcttatcaagggcatggctaagacgctaataggccaatggttttttgtcaaattacaactgaggatctgaagctaactctttggattcctgagtttttctcctccactgctgtaagtaaaagatttctttttggaagtaaacttcatgagatgccttgttatggattatgtacagctctaataagagatggtttctgtcctatgaggcttataatcaacggcttcagaataaatgatttaaatgatttctgaaagactatacatgtcattattgcacactaaaatcttaaaactcttatattcatagaattactgccttttcatttctctatctttcagatagttttgaaaaccagtactaaactactgagcaggactttccttttttttctgttgtggttaatgagaaacttctaagaaacactttccttgtgctatcaatttactcacctgattctaaaaccctcatcttagatgtgtctctttctccttttccaaagtaaaacaaatatcctcttaaaaagcctctaagttcttccacaggaatgtcttcccattttactaatatcgaatctgcagaagtatcctcaacagtaaaatttggtgcaacaatgggagctgtaaaaggaaaaagtcaattgctaaaggggagtgtatgaatacagagtaatacagtaatgtttcctgagctttctagcctcaaaaataattcaacttggaattaaaactttatttaatcataaactttcagagagagatgatcacaaacgctttttttgtgaagcttacatactaataaccatagacaaaaatatttttaggaacaaaggtagaacttacaatatcccttttagacaaacacatatctagggaagcaatctatgcaaaatctttcagtggctattcagatagacttcatttgtatttcacatctttattgatagtcctgaagaagttaatagttttttaaacttgtaaaagtactaattaaatatttttgacatccaagttcagatttaattttcctgaggacgagtaaaattgtgaaatgtaaacattcaacaaatgatttcagagtaagcaggcccagtgcagtggctgatgcctgtaatcccagcactttaggaggctgaggtgggaggatcgtttgagcccaggaattttgagaccagcctgggcaacataatgaaacctcatctctacaaaaaaaaaaaaaaattagctgagcatggtggcatgcacctgtagtcccagctacccaggaggctgaggtgggaggatcacctgagcccaggaggttgaggctgaagagagccatgatctcaccactgcactccagcctgggtgacagagtaagaccctctctcaaaaaaaaaaaaaaaaaaaaaaaaaaagaggaggaggagaaaaaagtagtaatcaaatactttttaatttatcaaattattttaccttccttcaattatacatcttatttttagaattcaatcataccattgttgccaatttataatttctcatgttgccttgagctcttataaataagtacccatttaacttacccaattcttctatatatccaatcatggagcgtaataattgatatccttgatttctgcatccatacaggaaaaaattatatcttatacctggtcgaaactcatctataggatgaacatatcagcaaactttcataaatatattactatgaatatctattttagaaacatcaagttcataacatactctaaaatttccaaagctaattttaaagatgttttcttattaaaaaatacatatatattttaaagactagtaaatattcaaaagaaaattgactaaacaaaaattaaatttacttctattttaacaaaaagtttagtaatataagatgggattgcattgaagagaacaacgatgatttaaggcttacattttgttcctttttccaggaagaaatcatcattgcttgatttttttttttttttctttgacggagtcttgctttgtcgcccaggctggagtgcagggtcatgatcttagctcactgcaacttccgcctcccgggttcaagtgattctcctgcctcagcctcccaagtagctgggattacaggtgcccgccaccgcacctggctaatttttgtatttttagtagagaaagggtttcaccatcttggccaggttggtctcaaactcctgacctcgtgacccacccaccttggcctcccaaagtgctggcaactgcttgattttaatgaacaaaatgtaagtctacatcaacttcctgggtcagttcactaagccattcattcgaggtccacatcatgcctctataaatcccttccttacctagtgttatttctgagttggaaaaagcaaacaaacccactgctctctcctcttgttccaagaagcagaattaaaagttgcactctgccttgaagcttcagtgttaaaggaattaggtcttagagtttattcctctttataacatcaccattaagtgtccttgggtgagttaactccacaagatatagaaatactttgaattaactccacaggacatagaggtacttccaattgaagtaccttaacttaaattcaaaaggctgcttttaaatgtctcctgaatacaatgcaatgtgtacaatgtgagcaacacagacatgcacaaaacgtcaagcatggagacacttgcagagtggtggggaagacagacgaacaagggtaaccataacagtgtgttatattagaggtatgtatcagatgccatggaatcttaagtgaggggccaaatgagtctaaaaagatcagaaacagctacaataagggccatctgaataaggccttgaagggcaattagatgctcatcagtggtggtcgagaaagaagataatgccgggggacacgcaggggggattggcagcatatggcattgcatttaatttgcagaatgcaattattctggtgtggttaaagcattagttctccaatcaagtgcctataaaacaccagtggcctacaggctccaatttgagacagtagtcaacttctaacatcatacaacccaagaaaaactgaatcaacttgtctaaaatattaacttttcttcttgtaatcactttccttaaacgtttgttatgtgctggcacgtcctaagtatgcagtaatgcaactcaagctcagccaactgtgtttagttttgtaacatttttctttggagaaaggtatgcttgaggttatcattttatactgcatgtacatctgtaaatctgtacctctttttatgttaaaattatttattaacaatattttatagggctctgacactttaaaaaaagaggctgagaaggttagagcattaggaatgtgctaaggtcaaaaaagagagtggacagcttaatgagtagagaacaggatgagagaggaataaaaggtgtgcctactatgtgccacttgctgttccagaagctcagcagtaaataaaagacaatattcccagcctcttgaagctctgaataactctgaatttgaacctgggttctatcacatactaattttgtgaccttggaaaaggcacctaacttctctgagtttttgttttctcaagctttgtgtctttgttcaattgagttggcacagaaagttctcttcccacaatcatcgcggggcagcttccccatatcctgcaggtctcagctaaaacttaaatgggtagatactccatttatatccactccagcctatcccagtccatcctgattattctaaaagctcaggtgagaaaggacagactggaatcgtgtaaggctcattcagcaacatgggaggggatggaagggaaggtgcaggaaaagaagggtagcatgtggctgggtccttgataagtacagtgcactgtaaggaaggataaagggaacaactcaggaagatcattaccacttcagccaattatacatgtggaggagtttggctgtattccaagtagaactggaaaataatctgaactcatacatgataatccaatgaatgggacccatcctcatcatctgagagagaaacagtaagcaagtagaaagtgttccctgagagagaggtaaggagcaggctgcttgctcttctgcacttccctaacacgcgagggaggcaggagacaggaatgatcacgaagcatcactactgacaagctacagggtccagaaatcccatggggacaggcaggatacactcccattgtgccaggaaaacaacgatgatattgcagagagggctctaattcctaaggacaaggctggattagcctgtaggttattaaacactcctctgtggaaaaacttctcaggctgcatcccatagagggacactcaccggcagctcacaagctcctgagcatcaggctcatggaacgcaaggcctcccacccacactgcgctcagtccagccgatgcccccttgccctgcatcagggttaagtggtaaggggttcacggtctttgtgctcagtctctccctaaccttggtaacctggaccctgggcaaacaaggcaaaggcccttgtgtgagaccaggctacagttccgtagtttttttttttcatgaacatttatttaattttccacataatttttaatgttacttaacattccattttataggtgtaccatcatttactcattcccttatttgctatttgggtttttaatttttcacaattatcaataatactgtcatgaacattcttagattaaatctgtgttgttctctgattatttctaagaataaatttctagaccagtaattaccagatcaaagggtttggatccttccatgtgctgccacaactaccctcccaggaaagtcaaacctatttatacccatccagcagtaaagagaatcacttcactgcacccagtcttacgtgttgccttttaaaaatattttgtagaacttaattgagagacactaattcatcttaccagattctattacagtttcagtgctgtttgagggaacttttctccagtccataaggcatggttccgaccgagacgagttacaccacttaatgacgtagtcgcaagtcatgttggggtcgtaatgccaggtgaggagaatcccctttcccatcccaacaacttgttctattttgagatcatcttcaataagaaaggaggatattttactggcattaaaaacaataatataaggcaaatctcataaaaatggacatgagttagaaaaatcacttcattgtgaagaaattataaaatagtgctcaaactagataaacctagagcaaagattagaagtgttgctctgttattttcattttaacaactgtagcacttacctgtatacatagattaacacagcagctcaaagaaagtcgtttttaaaaagcgcctaggatcaggtagtgacatactgggactaggacatcaagatcaaggcacaggaaggacgcagctaaggacactggctgggacagggtgggagagggagactggggaggggacagtggacagtctgaagccctcctctcatcactcactatgaatgcgtgcagagaacaagcggggcccagtacaatgtgcagagtaggcacacaacaaacttgtggaaacagcagaagaactagccccctctttctttcaacgaagactgcagcccaagagctgggctgaaggggttgtctggctgaccaggggtagggtgggggcaagggagaaagctgtggagacacccagaggcgatgaggtgggatggccagtgtggacactgagaaggagaagtctgcacagcgtcctaggagacaccaaggggcaaggggcaaggggcaaggggcaaaggctgagggcagaagacaggcgcagaggccctggcaaggttttgtttccctgtcttgccagatcttggcctaggtaagaagtggaaccccaggctgggggtgaagaattggggtagaagatagggcagtgtggtcaaaagggagaagaaaatttcccaccgtaacaggagaaaagaggtagattttataactgatttgtatttaagggttcagtaaaaacaaacatagaaaggtttctaagaataaatttttagacgagtaattgtcgcaggagccagatgctcaggagcctgcaaactgcaggtgagcggcccttgacgggatgcagccatgggagagtacttaatcacccacaggctacagagagcgttcagtaaaaccaacacagacattacccactgtaacaggagaaagtaactaatagctataactgatttatatttaagggttcagtaaaaataaacacagacaagttttttgaacaaaatgtacattcataaagcaactactactaaacgcaagacaacaatttggctgagaatagagaacacttcggacataacagctttttttgctcaacgtgattaaaaagccacagtgtaaacctgagttgaggctgcagagcctccctccactcgggaaatcctcaaggaatgaggatttgttctggggtttcagaaagtgtctggaagctgatgacagaattgctagttctgtaaattaccattttctaagggatacacagaaaaggtaggattatgtttcctgaattaaaagacaacatagctattgcctagcattgtgagtgcaatgaaacatataatctaaatcagtatgttatcttcttatggatgttcacatctctgtctccttcattttttattttgttatttttgccaggccaaaatgaagaagccattattaagcccctcctcccagcacctgccacaacccctgtgcatctccagcagcactgctgcctggggtttgtatctctgaaatgcactttgttttcccccttccttcctcctaattctcctatgactgactcaaagagaacaaagatgcagtcaagtaacaataagaaacagcctcaaactggagttggaaagctacttagaggaccctaactggaccaatttttcttcctctaggagctgtggttacagaaaggtgctcccatatcggggcaagagagcaaaggtgggtaggcagaaaatgactggagcacagaggtctgtggaagaagaggtggaagtggccgtttaaagctcataactctcaaagttgtcaaggcagaagctgggaagaatgtattaatcactggacatctgtaaaatttaaagaaaggcactaaattttaaaaactacaccacagttgtttttctaaggcctatattgaagatctaatttataccttaagaagactttttttaatcaataaagaatttctattaataaggaatttcttatcaaaaaaggtgctaattaaaataagcgttttttttttttcctgcccaacaatttgcaaaacagcctagctgacctaaaataaactttcctagtcttggggaagtgtcttggagaagcgtctgaatatcatttgaataaactcttaaaatatttcttcctaaaagtactatccaccactgtaactctccaatattatccactatagttactgagtacagtaatgattgtatccatcagtgcacatgcttcaagtcaatactaatgacttctttctcaatgaactgtagacatcaatctgctcattctgccttctaggtcagcagcaacaaggtatacgagaagaaggctgacatgacaaaagagcaagtaacatcagacatttctcactttagtttcccgttcttatatactaaatcatctcaagcactcaccatttggaatttccatactcgctattttggaaggtggtgatgagcccacagaatttttagccactacgctgatgatgtagtcattcttatcaagtcgtatctctgctttgtgctgaggatcagggatttcagaaagggactgtgtttcctcatctgatgaacacgatacattgtaggaaagtatttttccattagcttcattaatgggtaaaggctatgaaaaacagacaaattgttataaaaccctgcaaaacgtgactgtgactaggcaaggtaattgggtttaaactggacactatattaacaataacaaggttggccaggcgtggtgactcacgcttataattccagcacttaggccgaggcaggtggatcacttgaagtcaggagttcgagaccagcctggccaacatggtgaaacccagtctctcccaaaaatactaaaattaaccaggtgtggtggtgagcgcctgtaatcccagctacttgggaggctgaggcaggacaatcacttgaagccaggaggtgaaggttgcagtgagccaagatcatgccactgtactccagtctgagcaacagagcgagactccatctcaaaaacaaaaaacaaccagttacaaggtagtatcagaaaagatgaagctggccaagtgcgcctataatcccagcactttgggaggccgaggcaggcggatcatgaggtcagcagttcgagaccagcctgccaaacatgacaaacatgaaaccctgtctctactaaaaatacaaaaattagccaggcatggtggcacctcaggaggctgaggcgggagaatcacttgaacctggcaggtggaggtcacagtgagctgagtttgtgccactgcactccagactggttcaaagagcgagactctgtctcaacaacaacaacagcaaaaatgaatctctcaacagtgtaaaacacagatttaaaatccactgggagcagggtaaatcaggaaagagacactgaagaaaaactatacttgctataagcagtaagagtacacaaaaatttaaaaattaagtgaataaaaaacaatatttatctccacatttttcaggagcaaaacttttaaaactatccagaagcactgctctacttagcaacaaacaaaacattttaaaaaatagcatcatgggtttttttctaaacatttgttttctcattttaaagtattacatgcccactacagaaaatttggaaaatatatagaagttgaaacaagtaaaaatctcccatattcccacctcttaagtattctttcattttgatatttctttcaagttgtttttctaggtatagatttttttactaacattgttttaatcatattacaccattttactttttacttttccataatatatgctaatatacgcttgtccataatacagttatatacattttcatggttttatgtcttatgtagcatttttaccagtgtacttgaatatcccttaaataaatgaaatttaagttgtttctaatttttcacaatactaaaacaaatattttggtgaacttttttgtgccactttttttctttttcatagaaatttttaatatgaatttctaaaagtgaacttactgtataaaaacaaatgaacattcaaacctcttcatttatactgaactgcttttcataacaactgccttaatttatacaccaatgtatggggctctctggtcaagactgaggatgatctaacactgcgaaacactctgctccagcagaggtctctgtgatgctccaaatggcctgctctaaggggcaggctttagtcctaagacttatgggcttcttgggatactccagaccacacactgtttgaaatgtcctcctcccccagcttctctaattctattttcttcgttgttcctgcccctctaaaccttccccatctcctctgctggttcctcctcctctgctggttctatgcatgctgctgtcacctgggctccatccctggcccacttttcaccttgcatctccaagtgatcccatttatatgctactcaaagctgttttcagtgccaacctctcccctgagctccagagccttacatatatcaaaccgcctactgaactctactcatgatatcccagtggcataccttttgaaaactcactatgaccaaaactacataatttctacccgaacacactctgacttggcaaatggcggcaccatcagcatagataatgaagctagaatctaaatcatttcaatgtttttagtcttaagttttcgtctagtttgaacaatatttcaaactttcgtatattgaagtaaattgtataatcgttgctatattatcatgaaatctgacaggcaactgagagtagctgggggattttctaatcaagagtggatgtaacagtcaaatacaatctcaaagcaatggaactcacattgaacctgcatgtacacttcactttactcaaagctgtatcgacgtcaaaagtttttttaaataaaattatgttttactttccataacaaaattcactatttaaaggaatcctattatgactgcttgtgtaaaatctaatatagaaaacaattgttcatgtttttgatattcataaaatacttaaaaatatggcaacaaaaaatgttccagcagagaaaaattagtaaaatatgcaattcatatttcatctaaatactttacaaaatcatacaaaactttataactggcatgttataatgcaatttattgaagggaaataaattacacatgaagtatataaaaatttactttcctattaatagaaaaaaatataacaaacacttaggattctaacctacagattttgactgaagtgagggagatggaattcatgaaatcttcaggtcctttacaggccttataagatcaaactcgagaaggctcagatctgacacaggagatcctcaaatgactgtggggagttaggagtgacgaggaatttggggggtttaggaaccaggttagattctcaccaatattgcaacaaaagccagtctgggaagtttcagctccttgataacccaagtaccatgcgtaagttaagcagtttagcaaagtaatgtaaatgttcacagaaaaattagatatttaccttccaatagattattaaattttttccatcagaactccactctctccaagtatcaggcccctttgaaggacctaaaaaggagattttaaagttaatatctgaagacacatactatatgtatatggtgcttggcattttttttctaggatgtttggaattctcaataaaacgtgaagcagttcagtggcttccacttagaaaatgaagcaatggaaaatctaagctctcaacaacttttgcaaaacacacggccccctcgaatgggtgaaaatctacctgcaggccagctgtactgattccctgggttcccctctgcctcacatcctctcactccctcctttcttggccacacactggcttcctggctgtccctcagatatgccaaagacacaactgcctcaggctctctgcatcttctgtgccctctcttcctctgcctacaactctcttctcctagataaaaacaatatggcatgcttcctgatctttgtatctcagcttgagtattaccttattagtgaggtcttttctaactaccctatttaaaactgccattcccttcaccccctccttatccctcagcctctattcctatcacttcctctcctctgtggcatttgtcaccagctgataaactgatgtgtctgtgtctttgtgtttgtgtgtgtacatacatacatatagatgtgtatatatataaatttatttctagtcctggatcctacaaactccataggccgagatctctgttttatctgctgctatatcactgctaactagaacaattccagacacatacaggttgagtatccctcatccgaaatgcttgggagcaaaagtgtttcagattttggattttttctaattgtagaatatctgcatatacataatgaaatatcttggaggatgggatccaagaacacataaaattcatttatgtttcacatacaccttatacacacagcctgaaggtaatttcatacaatattttaaataattctgtgcatgaaacaaatttgtgttaagtacttaagtgtggaattttccatttgtggcatcctggtggtgctcaaaaagttttggatcttggagcatttcaggttttcagattacgtatgttcaatctgtaatgcatactcagtaaatatttgttgagtaaattgatgccttcatcttaatgaggtgcaaataagatgtttcctcttggagacaacagctcattaactgaaggcaaaaactacagtggctagtctccaaaatgaccaataatccccatgtgcgtggtgccctcccacattgcatcagggttggcctgtgtgaccaacagtgtgcagtagacataatggtatgttacttccgattttagagcataaaagatactgttcagtcaccggctctgggaggaactggctgccatgtcatgagcacacttaagcaggcctagagagaggcccacaaggtgaggaactgaggcctcctgcctttagccacatgagtgaaccatcttgaaagtggatcctctagccccagtgaagcctgcagtccccacccacattcctgactgcagcctcatgaaagactccaagtcagagagatccagctaagctgctcctggatttttaacccatagaaatgggaagatcataaacatctgctgtgttaagccactgaattttagggtaatttgttgcacagcaatagataactcatatcctccctctctgtactcatgcatagctttcacttttgatgatacaagtaattcttacacatgtcgcaaaatgccctcatctctattcttcacatgtcttcatgtggagaggcaaaaatctagattaacatctatcatttatttgctttgctatttcttaaatttttggaggaagtattatactgcataatataaataaagcttttgctatcttttgttaaatgattcctaaaaattaaacctatttcggccgggcacagtggctcacgcctgtaatcccagtactttgggaggccaaggcaggcacatcacaaggtcaggagttcgagaccagcctgaccaacacggtgaaaccccatctctactaaaaatacaaaaattagccgggcgtggtggtggggcccctacttgggaggctgaggcaggagaatcacttgaacccgggaggcggacattgcagtgagccgagatcgcgccattgcactccagcctaggtgacaaagtgagactctgtctcaaaaaaataaaaaattaaacctatttctgagtttttttttttttacacctgacatctggttattcgaagatagaatatcattctgtctttggaaattatcatatttagaaaaccagttacctgattttatacctaacttgacctgggtatactacagaaactgaagttcaagaccttttagccacatttctcaggtctaggtcacaaataaaaactaacaaattctcttttttagtaattgttttttttttttaaaaaaaaggccaatgagttaaaagcataattaaaattccaagcagaaaagaatgggagaaaaatcattctatgcattatcgtaatatggtggcaatcatagtatagatagaggagccctggctttctcataatttatgccaatcatttttctatactatgacaaaacttcaaaactatcatttaaaatatctgtgatattttattagcaggtattacataatttatctaaacattcccccacctttaaggactctaatagcattttttttttcttatttagagacggagtttcactcttgttgcccaggctggagtgcaatggcgcaatcttggctcactgcaacctccgcctcccagattcaaacgattcactcctgcctcagcctcccaaatagctggggttacaggcatgcaccaccatgcccagctaattttgtatttttagtagagatggggtttctccatattggtcaggctggtctcaaactcccaacctcaggtaatctgcccacctcggcctcccaaagtgctgggattacaggtgtgacccactgcacccggccaacatcttctttttaaagaagttgtaaaacttcagaatacacagtaattattagccatacatcacttagttaacttactggcttctgttgttaaatgttgttttttattgctccatttgctccatttccagaaagtttcagtagaacaacgaatccgaaaagtatatagagtgtatggatttaacttgtccagagcaacaagataacttgaattttctactcctttgattgtgacattccgctattggaaaacaaataaatatatatatatgtatatattatgtgtatgaatacatatatatatacatacacatacatacacttttttttggtaagaaagccttcacatttgtaacacaaaccaacggaatgtcaatgagtttgtatatgtaacacccaaagcagtttatccactgtaatattttaattcttatatacctgccaagccaatgaaattatgccctgtaatagtaataaaaaattgggttatctttttaatccaaatactggctctaagtaataatggtcaattaaattatctaaaggattatataattttgataatcaaagggctaatggtgatgcaataaaccttaatgtgatttataatttgagatgactgtgaggaataaatgtattatttggatgatatttggaagtttcttggaggcaggcattaccttttgtgcatctttgttaatatgacacttagaacttctagtatgatgctaaacatgtagcaaatattcaacaaatacttccttaaactaagtaaatatagttaaaatgaaacatttctaaacaaatttgaatatctgcctgtttcacaaaagcctctgagctccccaaaacattacaaagaaggttttcaggttatattttacagttgtgactgattttctagacatcagtaaatttccaaatgaatagttaagtacacctcatttatttcagacttaccacaaattacaagatagtataatataaaagtcaacctaaatatttaaaatgtattaaaaagtcatgttgtgacttttaagtaccaattacagcttgttcccactgccacacttcacagttttaaaaaatcacttctgctgtctagtgccaattcatccattaatgatgctaaaagttacagcaaaaactactcattcattcacaaatttacggagcaccagctatgtgccaggtactatagtgcatctgggaacattctgaggagtaaaagtcatatttacaattgtttttcaaatgatacaatgctgttattacatggatagtaatgtctttcttggttcttagtaaatctctataataaataatctgagagcttaagcatatcaatttgcttaattctttttgagaactattttatccaaaataatcacaaaggaagtctttaagagaatcttacctgctcttgtactgaattagatttcttaatttcaatttcacataaaaaattaatctttgcaaagttgcctggtaaatgccaagaaagtttaacagctgttgaattaatatccttcactttgaatgaagtaggagtatggggataaactgcaaatataatttttaaagattaaacacttatttaaagggaaaaactatcttctaatatgacaaatgagaagaaaacataaaaaacaacgaggcatcattagtgctgaccaacaacatcctacccagtatttgtggaattgacaaacctaatttctactactgacatcttgccaacatttttaaacaatcgatcatgctcaaagctcttaaattagtgtcaggaatactcaaaggtagttaagatcacagtatctacctttaaggaacttctaatttacttagggaatgaccaaaaaaaaaaaagaaaagaaaaaagaaagaaaggtaattaataagaatataaatgccaagttctaaatgaatgatacagatattaaccactatgtaaatgtaagcatggtaaggtaagtcttacagtgaagatggaacttaagatgagctatgcaggaagaatcagacaaaaattagccaaaaaaaatgcagaaaagcattttaggcagagatgccaataatgaaggtacagcgaggcaaactgcatattacactggtgatagtgtgtatgcccagttgagtggcgggaaagaatcacatgggaaataaggctgaaatggcagagggcagacaaatacatacaaatactaccatgcaaggataaaatgtagccatggtgacactaggaaaaatccagaaatcgcaaagacgacaggaaagaacaactgataaaagtgacttatgcttacaaataaggcaacaggatcatctactaatcagctgtgagactgtatgagacatgccttcggtttaggccctttctcccctgcctgagtctctaagagaaggtctaggccgttgctcagtgtgctgtgagcctgacatggagtgttaatgcacatggaccatgggaatgaataccaaaaagaccaagcacattttatttttatttggagctatatattaatacgattggtaaaaatgcaatcagtaataaaagggacgaactattaatacatacaacaacatggatggctctccaggacatccttaaaaaaaaaaatgccaaactgcatactgtatgattttacttatgtaacaatctcaaactgataaaacagagatgaagaatagattcgttgttgtcaaggcacagggatgtgactgtatgtacaggggatgctggaagggcaacatgagcaagttcctttgtagtgacagggcagttctgtatcttgcatgtggtggtggttacctgaatctatacctataaattgcatagaactacacacacacacacacacacacacacacacacacacacacacacgagtacaaatgaatgcacataaaaactgagcaaggtcagtagtctagttaacagtgttttaagagtgtcaattccctggttctgatattgtactagaattatataagatgacaccactgggaatagccaggggatgggttcacaaggctcttattattgtaactaccagtgagtcaacaattacttcaaaataaaagtttttaaaaattgggcagaagatatttcagaaatcaaaaattatcagaaagagtaaattactaattcaagtatttaaattcaataaaatagtaaaacttgaaattatacatttaaagtttttataaataaaatttatgaaattaatattaagtaactataaagaaaataatcagcaaaaagtaatccctataagcatttttcattaaagcatttcaccacttttaaagttatttttaagacattagtttatgtacagcttacctttttcagttatattaactaaaattgttgattgtgatcgacccagcggattgtgagcattcaaagtaaaattatatatttcttgatttggaagcatttgaaataataattgatagctttcgtttgtaggtgcttcagctcttttaagtctaacatattttcctgaaaaactgttaattaacagaaaaataatttcaaaatggcaagagataaatattgcaggaaaaaacgggcaaattcgtaatacttaatttgtataaaaagtttaaatttctaattagaagcatattacatactcagagaagaaaatgtatgtgatacagaaaatagaagaaattaatcagccataagtttactaccgagaaacagtctctgttcatgttcaagtgttcttcattctaagcttcttaaaagaggagacataaaattgagtgtacatgtggctgaactgcagtgcttataagtgtaattttatacagcatatttggttttatatcttgtttgtaacataaatgatctagtgcagttccctatgtcatttaacatgcacttccaacgtactccttgccatctgacatcttttcccagttatcattacctttcaactaaagtgtagcttgtagcacgtgggcccaccaacgctgtcacccttcctggattccaactacatataatttcttttaaatcatgtgtctcacaattcagttgttgaggagtatctggtggatctaacagaaaaaaaatgcaggtacttatgattacatatattttccctgaaaacataatattttataaacgtcaatgttttccacaatttcctaaaaaatgaaataatttactatttacattttacttttgaataatgcaggaattattctctctgtagcatgtcttgtcagagttcatattacattagaattgacagattaaaatatactgaaaaatgactcttagctcatctggaaactccctgtagcaacttgaaatatcagttgtcactttttttcccttaatcctatttcagaggctaccaaatctctcaaagaaacctgagtctaatatgttgtcagagaaatctacaggttaaaagtattatcatctatcatcaatatactgtgattcgaaaagaaataccaaatcatattgaaaatcagtaagtcatgttacatgtttcagagttctaaaatacattataagtactgttgtttagaaaactcttggtaaaattctgcatctcagtatatacaaactgactgcggctcttttgttgtttttctctttatcaaaactgctctccccagctttaaggcaggactagaaaaattaaaagaaattttttttttttttttaagacgagaccttcaaagtgataaatgagcccaggtgcagtggctcacatctgtaatcccagcactctgggaggccaaggtgggcaaatcacctgaagtcaggagtttgagaccagcctggccaacatggtgaaaccccgtctccactaaaaatacaaaaattagccgggtgtggtggagggtgcctgaagtctcagctattcgggaggctgaggcaggagaaccgcttgaacctgggaggtggaggctgcactgaacccagattgtgccactggaatctggtctgggcgacagagcgatactccgtctcaaaaaaaaaaaaaaaaaaagtgataaattaaaagtctgcagtctgacactgcttattgtagaaattcatatttctgtaatcatgtttaaccatacacatatagaaactggtatttcctctctcatatttatccaaactatctttcactttaggtaaaagttcttttttaaaaaaactacttgtttaaaaattctgtaaaatttttttttcacaaatctgaattaaaaaaaaaatactccttagtttatcaaccaaaacttggaaaatttcataccttccccagagataaggataacatccttcaatgatatttcaggtaacattaagaggattaatgagtgtttatatgagagtttaacaattagataagtaaacaaacattgacatatttattctgaaaattgttttaaatctaaggccaaatattcagtcactctattaaaaccacataccaaaaatatggaatatatttaaaatgctggttattttaggatttggtagatattaagttgaaatattaaaatctaaataacaagagcaaataagagataaatagaaggacagacagaaggggaaaaatttgagaggacagtatttgaaatgtactaattttcttttcaaagaaattaacttataaaataatcaactgaagctactaggttaaaagctaggtatacatcaactacatttttatataccagtcaatagaaaatgcaatttaaaaaacaaagtcatttttaataatatcagaaaacacctagcactaggaaaaaatttaccaaaagacataaagacctcatattaagatgaattaaagaagactcaagtaaatgtagggatataccatgttcatagtttgggagatacaaatattgtaagaatgaaaattctcctaaattgatccacggatttaatgtaatcccaatcaaaacgccagcaggttttgattgggtaggtgtgtgtgcacgcagacgtgtgtgtagggaaaaactaacaagccgattataaatttctttttcttttttttttttgagacggagtctcgctctgtcacccaggctggagtgcagtggtgcgatctcagctcactgcaagctccgcctcctgggttcatgccactctcctgcctcagcttcccgagtagctgagaccacaggcgcctgccaccatgcccagctaatttttttgtattttctttttttaatagagacagggtttcaccgtgttagccaggatggtctcgatctcctgacctcgtgatccgcccgcctcagcctcccaaagcgctgggattacaggcgtaagccaccacacccggcctaaatttcttttcagtcttttccgtaaatggtggcttaacaggatatccataaagaaaggaaataaatgaatcctgatacctaactcacgaaataacctgctcttataaatttcctaaaagttctctctgaagggagatgttactgctgctcaacaaatattgtacaatatttcaacctccaaacgttataaatgaaggttaaactataaattagcttgttctattactatgataaaagattacaacactgtctgaaataacacaaatggaaacagtgcacagtctcattttttaagttttaatttcttctttcatacttttaagtaatagctcacttttggtactgctcacgaagcaacttcactacatataccactgggtctcaacttagactccaggactatttgtgagaaatgttgcaagtaatttcctaacattccattaagaaggataatatgatttccaggatttaaatttgaacataacctcactttcacttgaattccaaatgcattactgagcagacaaaaagagagtcagattacagccatcaagctgagacgagcacctaaacccggctattcctttgggaatacatcagtatctgaatgaaattcatcacgaagtactgtatgagtaaacgagagagctgctgatctagaccacagctgagaatcataaaaagaaagaaagaaaaagcactaaggaatcaaaagaaatatcataaaatctagtcaatctatcttatacacattattcaggcgacctttagaccaaaatcccagacttctaattcagcataaagggaggaagggactcactgataaagatgaagctgtcagtgacaccaaaacattacagttgctacaaggaagggaggcagaaaaactaaaattgagacctaaaaattctacatatttatctgtggacattcaacacaagccacatgggcagggcagcccacaacaaactacttttggaaataccatggaattttagactgtggggtgatcatgttaatagacaccttgaatgacagagcatacaacatatatagaacgcagtgggagagtatgtttcccctcacccatgtcctcctgccagcctgttctcctcaaatataatagttaaaagatggagaagatatgttatgctactgaaagattttgtgtaaaattgctataatttctttaatttagatactttaaaaaaggtatactttaactggaaaatgaattcacataatttctaaacaatgcagggttaagaaatattatatcctatccttaacaaagctgttaactaagaatttaaactaaacattagaagctagatgtttcaaatctgattacaaaaccaacaaattacacagatacaggttatgtggaaaacaagcttgcaattcattttaaaacaagcaaatattctagtgcctttgtatagcctttatattaaagaacaaagaaatgagaaagaaacagaatcactcctcccacccccccactccagaagaattaaggctttcaaggaagaccaaaacaggttaataggaattctctctttaaaatcatatacttacatccagcaaaaataacggttccaaatatgttatcttcggttgtaaaaactacatttgttccactacttgcagaaacagaaatattacgaatcttgattgcaacattttccccatcaagatggatcaaggggcagtttgtatggccaatcagtgctgataacactttttcttgactcacacaacaaaatgttatgtctgagcctacaagtatcactttatcttgaggaaaaaccttagtctgagaatcaggtatccctagaaagaaaaagaggaattataaacattttatatagaagtattttacataaacttttctgcattttaagactttcttttcataagatgacttttaaaatagcccagtatatacactacaaactgttaggtgctttgtaatgataatggtccaaagataaggtgtgttccacaggttttgtaggagcaagatatatacgataaattttttaaaagtgtatgtggttttatttacttatgaagggataatggtgaggaagcagaagcagattacaggtcagtgtctaaagttaatgccacaggtttatgtctaagaagtctaagggttgaaattcagtgggtttatatatacatgtgaacaatccacaccccccaaaaatcactaattaaataattccattccttttattcaatgtatttagggcatatgtcttactttccatcagcctaaatatatgcccaagtactccacaccctaaaaaacaacttactttaatctagtccccttccttcctctaatccttttatccatagagtgatctatctctacaatgactaccagcctttcaggatttcattttatggtcaacaattttccaggccccctattcgaaactgccaacattctccctgtatatgagttttacttaatgtacggatgctttttggtatgcttgcagatccccgtgttcctggcaataactatgcagcctctaggggtctgctctgtgagccagaaattgggaactgttttgttttttttttttaaacatagatttcatctcagtatcatctacacacaatttttaatgctcttcaattcctatgacagtgattttcaaacctggatgtttatccaaccactcagaaagttctttcaaaatacagattcctgaagcctatctcagactttttgatcaaaatctccagggatggtgggcttagacgctcccaggtaatcctcatgcagctgaatgaggttatgagaagtgaaagctcaaactaaatcttactcttaagtgagactaatttaattcatctgaaacaaacattctttaaatataagcttacaagaaatgttcttcacagggctccagtcactccactcttcgagaccagaaaaatgaagattgtcaatgtagcatctaatttccacaaaatgaatggcacattccaagggcatatctgaggcccaactccagtgatgaagtgtatctttgccattcagagttgtgttgtgggtcacctaaaaatgaacacaaacacaaaactgtatttccaagtagcaatatgttttgctttcctttagaattaaaagacacaatagattccatacaatcatcagctaagtttatgttttgtcctttaatacaactcagttttgtgtaaggtataatagcagagtaacaataatcatgattcatttgtttacttcttcaactttaggccctaatgtattatataagatgttgctattcattgaaacattcaatttggtatgcaagaaaatgcaggttgagtatcccttgggaccacaagtgtgttggattttgcaccttttcagattgcattatatacttctcagatgagcatctctaatctaaaaatctaaaatctgcctggacagtggctcacacctgtaatttacccagcactttgggaggctgagacaggcagatcccttgagcccaggagtacaagaccagcctggacaatacggcgaaaccccatctctacaaaaaaataaaaaaataaaaaataaaaaaataaaattagccaggcatgctggcttgtgcctgtagtcccagcaactcaggaggctgaggtgggagggtctattgagcctggaaagtcaaggctgcagtgagctgagatcatgcaactgcactccagcctgggtggcagaatgatatcctgtctaaaaacaacaaaaaataaataaataaaataacaaaaatcccaagtctgaaatgctccagtgagcatttcctttgagcatcatggtggtgctcaaaaagttttgaattttaaaacattttgagttttggattttcagattagggatgctcaacctgtataccactgcctaatgatctaaatttttcatagagtagaagtaattaatggggttgcactttcaaaagcttaagtcaaggagaggggcagcatttcaataaaatagttttagactagatttgttttttatataagtattctatatagttgcttttatttttaaatagaagattaaatatgtaagttatactaatacaaattattattaattgtgagaaatgagcaagatttcaataaaatattgaggtgctataaaagataacttgggacttctaggcaaacacaatagattaaacaactatttccttctcccttacctcctgaaatcactccaaagagtaaacagattttttttaaaggtgtgaatggacaaagacaaaatatagaaataaagcaacatcactaaaatctggaagctggaaagcagatggataatggtaactgatgtagaagacctgagaaaacaaaatcttaagcatccaatgggaaatacaggaaaacagcttgtttctatcacagaaatgccaaagggctcagtgagtggctatcccaggctcccctggaaataaagagctcaaaacagcaggactgcttgaaagttgtttgaagatatgttggctacccagatcccttcccacactccacactaccgaaggactacctttgtttaccttggcagaagaataaagatttatgttctggaaaagtaaaacagaatatctttggattgaagaattttaggaagagatgagaatggggactatcattccaaaaacagggggattgctaacctatgccttcttcctctgctcagctcccaggatactggtttgccagactaatcctcaccaggtaatagtctaaatgaacttttctgagtcacataaacatgtcaaaatgaaatacctaaaataatatttggcgtttgccacctgcatagcccatcctcatcactctagagggaaggcccccatcaacaagtcctatccagagaaaccaaagttccaattagattaaaaaaaaatttttaacagcccctcgcttaactgtgagcagcaaccaggatgaccagaaagtgtacaagaaattctaatacgaaagtcaataattgaaaagaaaagaaaaagaaaaaatgtgaggaaacagggcatgtagaaaaaaactttaaatcattactatcctcagagataagacattgcatcatgaaacaaaaactggatacattaaaaaaataacataaatcctttcaaagaaaggatcttctataaattaataaacatatgaatagaaattcaatagcaggatgcaaaatccagtttagaaaaaatttctgagaaaatagaaaatacatagaaaacaagaaagataaaaacaattagaggattgttgtggaaggttcatgaagaacagaagttctcaaaaaaaaggagaagacagagaaggacaaatcaaagaaataaaacaagaaattcccaagctgacacacatgtgtttttagactgacaggggcccaatgagtgtccagaagaacagataaagattgatccacactaagaaacaatggaatcataccttcaaaatcttgacaaaatttcccaacctgtaattctacacccagttaaactagtaatcacgcacgagtgcagaatagacattttcataaatgtggtatctccatgtattcctttggtaagcattttacactctgcccagtaacgtatgaaagttccagttcctctacaacttctcagtaatagtaattgacaagcttttaaatttttaaataattaaattaaaagaacaaattatatttgcaagctagctattatagatagcagagaatatctacaatagcaaataactactgacagttggctccctctattcatcgctccacatctgtgaggtcaaccaactatggatcaaaaatacttggaaaaaaatttgcatctgtgctaaacatgtgcagacacttcttgtccttattccttagacaatacagtataactactatttacacaacacttacattgtattaggtgttacaaataatctaaagagggtttaaaatatacaggaggatgcccgtaggttgtatgctaacgctaccgagcatctttgaattctggtatctaagggaggtcctggaagcaatcccccaaaagataccaagggacaagtgcaaatgcttccacaaaaatgaggaaataagagaacgactggagatttggcaaaaagaagatccatcataagacaaagttgtaggaaataccctagatgatggagatcccttggaccacagcttcctaagaaatgtgctgaaagacactgaagtctatcttgagtgagttataaatatatctaggtattaatccattcaaacctagaactgcttggtaggggttggggctactggagcctctgtgatgcctctggccacaagcggtctcggctatttaccacactctgtgctatacaaatattatcagtgtctatgtgagccttctgtgaataaggttgggaagccagccagaaagccctcagagatttattcgcaaagataaaattgataaagtacttagtatatttgaaaattccaaggagatctacacagcctgcaaagaatttaggattaaagtaatgaagcagagaaataaacacaaaaaaacaagataatataaggagtgtacaaaaaattgtggatttttttatagaccataatacaaatgatgaatactgttctaccaaaaattatcatagactctattggaaaaagctaggaaaatggcaggctgcggggagaaggagggagagggaggagcagagagaaatgaggcggtggggggagaggaggaaagggagggggttgctatcaagaaatagcaacataagcatgttatttggagaaatgaagataaataatgaaagagatcagttaaaagagttgaaacaggtcgtttccagggaaagtcaaggaggagtatttgtgtgtgggggagcagtgcctggtgagctcttcccagtgtgtgcagcacacagctcccactgctggacacagagaccacagacagacaagtgcctcacaaatgaaacatgaatgcaaagtgttcttgatttttaaattattataaaataatagcattagtgcaaaataataggatatcataaaatgactgatcacaagcaattttgtcttaaatactgacattaataacgtactattaataaaaatgccctgaggcattttcccttactttacagttctaaagaaatgtgttctttctcattgcttcttgctattattttcccaaattttttcccaaaagtaaggaattactgccttgtcattggctgacttacacatgttgtagaatgagctatatggttttagcctaacagtcccttcatttaagtttgatttcactcacatttcagagtgtccctctttaattctagtattctctagttagttcctcctcaagttacattaaaaattaaaaaagcctcgtccctatccatctgacaaagggctaatatccagaatctacaaggaacttaaacaaatttacaagaaaaaaatcaaacaaccccatcaaaaaagcgggcaaacgatatgcacagacacttctcaaaagaagacatttatgtggccaagaacaaaaaggtcatcatcactggtcattagagaaatgcaaatcaaaaccacaatgagataccatctcatgccagttagaatggcgatcattaaaaagacaggaaacaacagatgttggagaggatgtggagaaataggaatgcttttacactgttggtgggagtgtgaattagttcaaccactgtggaggacagtgtggcaattcctcaaggatttagaagcagaaataccatttgacccagccatcccattactggctatatacccaaaggattataaatcattctactataaagacacatgcacacataggtttactgcagcactattcacaacagcaaagacttggaacccacccaaacacccatcaatgatagactggatgaagaaaatgtggcacatacacaccatggagtactatgcagccataaaaaaggatgagttcatgtcctttgcagggacatgaatgaagttggaagccatcattctcagcaaactaacacaggaacagaaaaccaaacaccgcatgttctcacttataagtgggagttgaacaatgagaacacacggacacagggagggggacatcacacatcggggcctgtcagggatggggggctagggaaaggatagcattaggagaaataccgaatgtagatgatggattgatgagtgcagcaaaccaccatggcacgtatacacctatgtaacaaaccttcaggtttgtacatgtatcccagaatttaaagtgtaataaaaaattataaaatttaataaataaaaaaataaaaagccttgtccctaaagggagtagtgacaaataatatttgtttagcagctttacagatatactatttactttgcagaccccagagcaaatattgccactttacaaaagatacaaactaggtttgaggagttatcctaagcctgtaagtggtaacccagaatgcaaaatgttaggccataatgacaagttaagcaatataatttaaataaataatacctttaagacagcacctgcagaactgtatcaaagctagctgcaaattagattaacagacaagacttgccattagaatcaagaaaagtgagagtctgcaggctgaattaagatgggctttaaggctgggcgcggtggctcatgcctgtaatcccagcactttgggaggccgaggtggccagattacaaggtcaagagatcgagaccatcctggctaacacggtgaaaccccatctccactaaaaatacaaaaagttagtcgggcgtggtggcatgtgcctgtagtcccagctactggggaggctgaagcaagagaatagcttgaacccgggatttggaggttgcagtgagccgagatcatgccactgcactccagcatgtgcaacagagcaagacactgtctcaaaaaaaaaaaaaaaaaaaaaaaaaggatgggctttaaaataagaagtaggcagatggggcaaaaaagtgagaccccatctctatgaaaaaaaaaaaaacaaacaaaaaaaaacagctgggcacagcagcatgcacctgtagccccagctactcaggacactgaggcaaaagtatcccttaggagtttgaggctgcagtcagctatatgatcatgccactgtactccagccaagttgacagagcagaaccctatctctaaaaacaaatgaataaaataaaataaaataaggagtaggatttgacctgggtcttgaaatgcaggttcgagtaggatacgtgagaaggggaggacattttaaattaaaatatatatatttcttataaaatataaattgtagcagttaagagcagactctgaaaccaagctgcctgggttggaatcctgactccaccacttaaagtcttcctgtgactctgtatcatctgtaaaatgggaataataatagtatcaccctcctgggactgttgtgaggataaaaagaatcaaggtatacagtaatgtgctatataacaatacttcagtcaatgtgggaccacatataccatggtgatcctataagattataatggagctgaaaaattcctattaccaagtgacatcatagccaacataatgtcatagtgcaacgtattactcatgtgtctgtggtgatgctggaataacaaacatactgtgctgctggtataagagtataacacatataattgtgctctgtacataatacttgataatgataataaatgactatgttactggtgtatgtatttagtgtactacactttctatcattatttttgagggtactccttctacatgtttttaaaagttaactgtaaaacagcctcaggcaggtccttcaggaggtattccagaagaaggcatggttaccagaggagatgacagctccatgcatgttactgccccgaagaccttccagtgggacaagatgtggaggtggcagactgttatactgatgatcctggccctgcgtaggcctaggctaacgtgtgtgtttttgtccttgtttttaacaaaaaagtttacaaagttaaagaaaaataatttttaaaaatacaaaaaagcttgtagagtaaggatataaaaatatttttgtacagctgtactatgtgtttgttttaagctaagtgttaatacaaaagagtcaaaatattttttaaaaattaaaagttctgaagtaaaaaagttacagtaagctaaggttaatttattaccaaagaaagataaaaagttttataagtttagtgtggtctaattgtaccatgtagactacagtggtgaatagtcatgtcctaggccctcaattcactcactgactcacccagagaaacttttagtcctgcaagctccattcacggtaagtgccttatacaggtgtaccattttttatctctttaaacattttattgatacatagtatttatgggatacatgtgagtattggttacatgcacagaatgtgtaatgatcaagtcagggtatttggggtatccattatctcatgagtattatcatttctgtgttgggaacatttcaagtcttctagctaccttgaaatatataatacatggatgctaactacagtcaccctacttgactatctaacacagaacttatatcttctatctaactgtacatttgtacccattcaccaacctctcttcctgccccgtcccaccaacacacccttctcagtctctagtatctatcattctgttactaataatatctttacctccatgagatcagcttttttagtctccatgagtgagtgagaacatactatatttatctttctgtgcctggcttatttcgcttagcgtagtggcctccagttccatcctggttgctgaagatgacatgatttcattcttttttatggccaaacagaattccattgtgtgtatatatcacattttctttatccactcatctactggacacttaggttgattccacatattttctattgtgaatagtggcatgataaacatgtgaattcaggtaaccctttaatacactgatttattttcctttggacagatacccagaagtgggactgctggatcctataggagttctctttttagttttttgagaaatctccataccgatttccatagtagttgtactaatttacattcccagtcgcattgtataagagcttcccatgctccacatcctcaccaatatataagttttttttgtctttttaataatagccattctaatagaggtgagctgatttgattgtggttttaatttgtatttccctggtaagtagtgatattgagcattttttcatacacctgttgtccatatgtcttcttttgagaaatgtctattcatgtcctttgcccacattacaatgggagtattaattttttaattgttgagttgttttagttcacggtaggttctggatattcgtcctttgttggatgaatagtttggaaatgttttctcccattcaaccgtctcttcactccactgtttccactgttgtgcagaagctttttagtttaatataatctatttttgcttctgctgtctgtgcttttgcagttttagccataaaatctttacctggaccaatgtcctatagtattttccccatgttttatagtttcagtcttatgtttaagtctttcatctatcttgagttgatttttgtatatgagagacagagatccagtttcattcttctgcatatgaatatccaattttcccagtaccatttattgaagatgatatcctttccccaactatgtatgttcttggtacctttgtcaaagataagtttgctataaaaacatagttatttctggattctctactctgttccactggtctatgtatctgtttttatacaagtaacatgctgttttgattactatagataaccttttaatatattttgaagttgagtagtgtgatgtctccaagtttgttcttttactcaggactgcttcagctatttgggtttcttttgacttcatacaaattttaggattgttttttctatttctgtggaaaatgacattggcatttttgtagggaatgcattgaatctaaatgtgcagattgctttgggcagtttggtcctgttaatgatattaattcttccaatctgtaagcatggaatgtctttgtgtcctcttcaatttctttcatcagttttgtagttttccttatagagatcttccaactacttggttaaatttattcctaggtactttatttttctgtagctattgtaaatgggatggctttcttgatttttcagccagttcattattagcatatagaaacacttctcatttttctatattgattttacctcctgcaactttactaactttatttacagatctaagttttttgggggagtctttacacttttctagatacaagattatatcaccagcaaagagggacaatttgactctctctttcccaatttggatcccttttattttctctcttgcccgactgctctggctaggacttccagtactattgttgaataagagtggcgtaagtggtccagtctttgggtcccggcagtggaagtggtaagccgagtatgcctgtctttggaccccaggatggcattcactggccccattgttagtgggtccaagggggccaattcttgagcgtccaggtggcttgcttggatgctggtattgagagtggtgggctgggtacgttctcaggcccctggccagcaggtgtggtgtgggtgatggcagtagcagtggtaggataaccctctgggtcttgagcagtgcactctggtgctgacagtagatacaatgtgctgagtgggccagtcttcaggcccgcaggtagcatgtgcagtaggtgccagctgtggtggtagcagcagggtgtgtgggcctaatctcaggcccctagaagaggtgctcaggtgctgatggtggtagactaggctaggtgattcctaggtccataggctgtaagttctggcaccagggcaagggaacaaagctgggtgggcttgtcctcaggccctctcgtagtacatgtagacactagctgtggtaggcaggcatgcggtgttccccatgctccctccagaatgctcaggtggacagcagcagtggctgtgctgcggccctgctactgaggaggaagagattgctttcaatggtagccataggcatgcaagtggggaacgcacaatttgcattctagtctcagtagctgtagtctgcgcttcactcacgcttcagccttagtggtggcacatcacgccccacttgtgcttcagcagttgcaggcaggggactctgggcacatggaatgcactttagcagtggagccactgctggtgttctgctggctgcctcactttcctcttccttccctgctttaggtgcttcctgtcacttctcttgaatcccgatgctctctctaggatgatctatttgaagtgtgaagatctactattccctatcttggttcttctttgtagagaagttgagtacgaggtgcctctagtcagccatcttgaagtccctcctccatttaaagtcttctataccatatttttacatatcttttctatatttagatacagaaatacttaccaatatattacaattgcctccattattcagtacagtaacatgccatgcaggtttgtatgtggcctagaagcaataggctattgtcccatataggctaggtgctagctgactattgttattttaggaatgaaatacatgggttgtcaaagagaaacaataagaaagtatgaaatatagaataatcttttttattatctttactattttatctatgtacttgagcaacttgaacaaataaactgtaaaatcatgagatggtcttctaattcttaaacctgtaactaagcaaactccaaatctatcaagaaaaagagtaaaaggctgaaagggagcatttccaggtaacagctgtcaaacttttcataaatgttgttcattactccttagaggccattcataaacaggaatgaaaaaacgagagagggaaaaagcatgtactgataaattcaagcttatagatttataaaaaaaaattctctatggctaagttctggctaaacatgcttcaaaacattagacaaaggtaaaataatacactaaattaaatgtgcactttcatttacataaaaacatgcatataaacaagtccagacaggaatacacaaaaacagtacttactattttcaagtggtagaatcacggcttatttctcccctaatttcctatgctatctgtaatggttacacatcatttaataattaacaagtgatttttaaatcatgcatgatgtttttaatgaaccctgaaaggtatctgatttacttcctaaataatccaaaagttcactgataccaccttaaggcttcttaaaaaaaattattcagtttctttaatgtcataggaagaaaatctatgttcaaacttactaattttacgagctccatactctctttacgtagaactttaatttcccagataacatttgagcggtgtggaaaaactgaacccctgtcgttccactttaggtataatgtagaggttgagaaatcagcagacaaattcaagatctctggagtatctggaattaaggctttaaaaagaggaaacaaaagagaaaacttagtaaaataagtaatgatttttcatactgtaactccactaatcaactacttataaactctattccttcttgatcaaaaaatcaataatcaagatttaaaaggaaactctagaacccagtaataaggacatggactgagatgccatatatggaaaagataaaatgtcatggatatttcaaagaaatgactggatcaaagaaatgaagggttggttctaatgagaaagggaaacgactaatattctctcaaatttctgaaaaaggggaacatatatattatttatttgtagaggcagctcccaatgcttcatcagccaaatttaagaaaattatttattagctggctgtttcaaatccacagcacattttctaatacaaacagcaactaggtttccacagtactctagtgtcatttagtcaggaacctacaggtaggcaacatcagagagaagaaaacgagtttcctctgtatggctgtagggcagccctaagaaaataacaaaatatagaaagcttcctttggtaaaggcttctctctgttttctctgcagctgtctcaggcatctcctggtgtcaagagtctctcgtgctgggggatgtcacccacttgagaaatgctatgggcattactgattttcaataccattaaacagtagcaggattgtctcagtgactaaggcattgagttaagaagccagtggttactgtgcagaagtagcaggatataagaagtgtgtcagaaaggttcctttatcagtagtatgcaacacagactgcgggggattgagacaggggataaggtgaccaattaggagaccactggagcaatcctggctagagtgacaaggatataaactaagatgccatctatggaaaagatgtcatggatatttcaaagaaatgactacatcaaagaaataaacggttggttctaatgaaaaagggaaacaaccaatattctctcaagtttctagctcagaaagcagcaagaggagcaaaaggaatcgggaatcactgtgaagagacacagaagcctggctatggatgagtaagggtcaggggaagaagacaccatggagtcagaacgtggatgcagacttaaaaggaactgattgagtgtagtggtagaaaagagcatgaacacaaagacataaaccagccaaagctccttttaggggctgccaatagacaattacatcttcaaggagccaaaaacaccaacatgaatccagagagggaatcctagaagcagaaggaaaccagagaaaatccaggatcatcgaaataaaaacaaatagttgttacctgtgccaaataaaacagtttatagaggaagactgtggaaaaaccactggcgaggctactgttaatatctgagaaagaagtttaggagaacagtgggctctgaagctgcattacaaaaggtaaaagagaaaaaaatccatgctcaaaggtttgggcatctcctagggagaatccaggacactaaaaaaggtagcaggaagagtaatgtatccttgaaaatcattaactctccctaagggcggataaatcatggaaaattttggaccaatggaaaacaaagaaggtatgagcatgttccattctatgaaatgtagactttctggtttgagaatcagagagacttggactttcttccatgtttcctcctcaaataacagtaaagtaaaggtgagttagaagaaatccatagactcaccctttcttgcctcatttctatcctagaagctcaaggaccaattacatatagtcatggtaagcccaaaactgcaggacagtgcagggctagggtagctgaatatgctaaataacaaaaagggcagaacaaaccaatacacattaatctcggaacttaaaaatagttattaaaaataggtttaactaaaatttggccaatacagtgttcaacactggatttatgtaaagtgtttagggctgtacaggacacagaacatgtggatttacagtctaaactacagagcaaagtcaacagttacacagctgtataaggacagtggaggatgctttaaaaagaagttttaagtgggcagctccttgtggaaaaggaaaaatgcagacaaacgagaggcaagaagttgatttagtgccaggacagggaaagctcagggtgccagtgtgaccagaaaagagcaagaggcttccaagaacacagctattctttcaaatgattcaggatgtcacatgatgtagtaacttacaatttatgaaacacgggagtattttactaagacaacgctcatctttaaaatgcttccctccctgaaaagtccacataatttacattttatttaaatagcagtgggctactcttaaaaatacaagtaatatccaacatttcaagctaaagacagtaatggccataattacaagtacaaggattttaaaaagccactgctccctttcttttctttatagcatatagggaagtttcccctaagctcccattaactgccatctgcatttctttgtgctaaacagacatgtgaggacaatgttaacttgctttctagaaactcagatagggaagaaatttaatgaaaatcttttttattttcttctaatgctaattcagctttacccataatctacgtgctcctgcttccttaggacataagaagataagagtattcccagcttttttttacaggacccacattctgcttcagaatgacccaaattttcaggtgattttaagaaatgcagaaattaaaaatcttatgaagaatttttcatgcttacacatggtaagtacaaactttactgtgtgtgtgtgtgtgtgtgtgtgtgtatatatatatatataaaatcttgtttgctttatataatttagaaagcatctttagatccacagacacttaattttcatacttttatttagtagcaaattgtcaagagatccagatcctctaaaggacagctatacatgcattgcagagcttctcttgcacacagtaggtgctcaaagatttgctgatgtatccatctcctccgttccttacactcacctaatttgcttttcaattttcttatcccaatactgttattctaatcatgatcaggaccattattatttataatgctaccaatacattacatgatatgtaaaacacaatgaactattaatcgactgagtctcctacagtctgtcttgatttgcctttctgattctaatactgtcatttttcagtagcttcccagataagactacaccctagagcaaggggcatctgagaaattctggaaggtacgcaggagtcaagggggctaaagaaagagtatggaactgagggaaggagcctgaattctgggctattttgactggccagaagaaaagtttgcttccttctgatcttggctaccatctacaattcatagggaggttgctgagtgaattaaaagtaatagcataacacatgaaattcaaaaaactagaaagcaccacaatactaacaagtgacacttgacttactttaaaattgagtttgttttcaaatacttacaaacgttttgttcatttagtgtgaatttacttgtagaacttccaaaatcatgtagagaatttattgttatttcataatcaccatgtgaaagagctggaattttaatactggttttctccaactgataacaagaacgggacctgtaataagaaattgaattttaattagcaaataaaattaatagtataattttcataaaaatttggttaacacaaaatacaatggaaaatactttatgccctctttgttgcaaaaacatgataggttgtaccgcattttaagactgaaaaaacagattgatagtaactttaccaatgtgggggtaggaaaaacaacctcattgtaccaaaagtagaataagcatagatgactccaaacagctggagtttttgcatgcctttcaaaatcccacctcaaccttccctttgtaggctgacttccactactcacactccaccccttcactgagggaccagtgcatcacagcgctcctcatgctaggatgatgttcaacggatgctgatgaaggaaatgaaactggcaactcccctgctcctctgccttggctcatggtttcttcttaacagaacttcctcttcagttctgttttcaaaatgcttccagttcccctggtatctcttaggcaaaatgatattttcctctcttgttccacagcccttgatatctctccagagcatgcttatattccttatactgttgttcatatatgtttcaaacttcttatacaaatgtttactttactgaaaggactttccatgcctcttgcattcctgcccccaccaactacccagccccagccttagggctgggtgcttaggactctggacttgaatgggtccagctcatctccttctaaacctctcacatggtgaggcttctttaggcatcagcaatgcaaaaacacctgaattctccaaatcacgccatctcatacattcaagccattgtactcaatattctttcagggtagaatgtcctcctattccttttctgctgagaaaactgactgtgcctactccagaattacacctcctctgacagcctttctagacattcatactcctagtgtccactcccttgcacaaaaaccacagccttgctactatttgtttattgtgacctcccaggggagcagggggccagaactaacttcctctctgtttggcctgtggtgggcatgtgtgctcttcagcaaacttttcaggctcccccttctggactcacactaagaccgtccttccctgcctctctgaagcaaggtatggccatgtggctttatttggtggcagaaatctgagtgacagtcttatctaccagatctgcactgaaagccactgcagactctgtcccctcttctcaccttgccatcacacctcataatgcttggtgccctacaggagaaaaatgaggcagaggtcacggcagactctgctggacacagaacacaagcaggaaataaccctttagtttcacaagcaataaggtaagaactgagggtcgtttctgcaattcaacctagctcattgtgaattaaagtaaattaaaattacctgttttcaatgcaaacttcataatcagtaccacggcctgttccagagggtgctttccaagaacagttccacacttgcaaattgttagttacacacttcaaatcatgaggagcccctggaggagacacacacacacacacacacacacacacagacacacataaacacagaatatgctgaataagtcaactgcactctaaaaagtcaaccattttcagttgtaagcacaagcatgtgtgtctgcagagagcccatgtttttttttttttcaaagagatgatcctgcaagtcatgggagtggactggttttctatttctttttgcagctttggttaaaaaaaaacaactaaagggtaaactgatgaaagtgggccagctactagaccattttggggttaggctgctatcaaaaattccacttccaagcaactaagacaaattaagggagtgagtggctagtcatgtagattcaataatgggaccaagagagggcttgaggggattctagcacctcttgaatcttcaatagccccacttaaggaaaaaacaaaaaacaaaaacaaagaagtcttaagtaaaaatgatgtgccttccaagtttttaaacaaaactttgaaactcctagtcacccccacctcattgcttgctaccagactgcccccttggtagaactcccataactaatctttaggttattatgaagtatattaaatttaaacagtaataaactcatgagttcatttgagaaatatatttttggtgtgggcctaaacaattgaaagtaacaattcagaagattacaatcctactagtacttactcacatctataaaataacattacaccatggaatatgtaagcactatgcaatgaaaaaagtcaccccgaaaagaaaatgagtaaaaagaaggggggtataagagagagggaaagagggaagaaaggagggaaacaaggggaaaaggcaactatagaataaaaaaggtagtccatctcagattctataaatgtttatgaaaaatgtttttgtttttgtacatggttggtacgatattcactgtagcaataaattatacggctatttatatgacagaaaaacaaatattacattaaaagtactcacattataaagcagcactaatcataataataaagtaatttaatgaatgaccttggagaaaagagatctatttaaatatggaaataatataaaaactaaaccaacgggcaggaggatgataatttctttatataaataagctataaaatatctacataaacattcttaatatatttaagatgtaacataatacatttaaaaatatttggatttcattgatatgacattctaaaaaggtaacattatagagacagaaaacagtgtctatggagacaaggcagtgctggcaggggatgggcctgggagggctgactacagaggagccaggaagcttttgcagtgccggggctgttccctatcttgattgtgctggtggttacataactacattcattgtcaaaactcacagaactgaatcttaaaaaggcaaattttattgtatgtaaattatattttaatttttcatggtaaaataatattttgatctatcattaaggatctttttaaaagaaactaaaagtacatagaaaaaagatgacaaaaaaaatgaattttaaccaacaaaatcctaaaggggtcaataaagcaacaaaattgcttcgtcatcaaaatggaaataaaactgcaatctgttcattctctggaaggctgatgcacttaccctttttctggctatttacttgattcattagatatagaagaataaatgttgataacagccactggaaatttgaagcagtcctcattcttttattgtccaccatccaggatggtcgtttcaaacatacgtaaatatccatcatctgtgcaatgcagtcagtcctaggttaggagaggaattccagatggtgttcagattgttctgaaggctcaccttatactgtgcacacaaacactcaaatagattctgacagattctgaaacactgtacatttagagactttggagatactcaaactcaagcttccctggcttgtggagacatcaataattggacacagctgttgctttaggtatctactacgaggccaattttcaaatgatgggcttcaagttaaagatcataactataattataaaattacaacaaaattataagcacatggctatcaactctactccaactctactaaaatgtagaaaagcagtgcatgagactgaatttttgacaattttaagtgatacctggattgatatttttatgtattttattagtacgttaacttgtgtttagtcatttatgacaagttatattagttttgtctcccatttacatggtgttggaaagtttctatttcatacaaatttaataatttaaaaagaaaaaactagggtaacagtatggagatgttgcacattggacatttagggatcccccagagtaatgaaattcccatccacccttcatcctttcttcctagagggacaccaccagccaacaagatccttatgatacactgaaaactcttgtgtcagacctaaaattgcctcatttattacaacattggcacagggcaccaaagatcacaaaacatataagcaaaggctaaaatattaaagagaaatttaggataaccaaaaggaaaataaaaagtacttccagagaaaatggggatgatataggaaacaagaaaacttaaaagaaaaaaaaagaacctaaaaaactctaaatagtgtcctctgagcaaacatggcataactataaaaaactagaggatgcaatgaaaaaggaataacaggaaataaaaatagctcttagaagttaaacatattgtctgatattaaaattaaaataagaaaaagattgagtaatctttcagaacaaaatacaaaaaaaaattgaaaatgtgggaaaagagataagaaatgaagacttgataaaggaaaggagatccaacacctaaataactggagcccattgagagaattcgaaaaaatatttttcttagtgaaagcagatggcaagatctcttctcggctactgtcaagtactgtcaaaaacccaggaaatgaatcccaaatagcttaattataaccataacatgcaaaaggcgtgagcacacatttcaaaagtgttctattattttctggatgaatgaataacttcctagtcaattccagggtcattgagtttacttagtagaatgaaaatgtattcacaaaatatctaaaatgccagttgctgaatttatagaattatacaactgtacaagaataactgagtaatggagccaaacatgaccctaaaactcaaactctgactaaaataatcataaaccatattcactgactggctaaacattatcttgaaatgaaacagtccctcactacaagtttcgattattctaaaaagagacacaggccctacagccatgccaggaagaagtgcaagaaggggcggagggaggcagctgagaaagagctctggaccaggtgcttccagatttagatgctaatcttggctccattactaattagtggtatggctgagggtaaatcacttaatccctccctgcttcagcctcaaccattggagcagagaggcatgctctctattcaggatccacataagagacttcccaaagcgaagctgtaatattccattcctgctggcagggaacaggcacgcagacagtagcgagctcgcacaaagcctatgccagcaacagccacggatcaaagactctgctgaggaggtcagtaagcaggaggaaggcgatgcccagggacagaaggatcaacggcagtgtcactgaagcctgcttaacttaagcaggataataaagaagactttctggtgtgatacatttacacagagaattctgggcaagtctatttgggcaatacaatattgtgcttataacacatcagacttccccaccaagcaaaactttcaaatggacttactgtgggccagaacaatacatgaacagagccttccgaagtactttcagaaaaaaagtgatgcttgtgaagcttttctctgctcactcctgatagaaacattgtcagaattcacttttttcccctgtcaatgccttattccttagaggagcacaaatttttatacgatttcaggagctaactttcaaaattaggatgcagcaacagggtgcaaatgcaaatatgcaggggcaaagcaagtaacaaacgtgttcacagcaggtgcaaactgcagcccctctgcctagcataaaagtggcagccaccagcctcattttgccaaatatgctgatttttccagatgaggtagaaatctggcattttaaatgaaacaccaaagtttgtaaatgtgagaaaataatgcatatgttttacacattctaaaggccagacaaaatatgctcatgggcagtatccttcctgcccaagggtgaccagtttgtttcctatactaattattttaaaggacttaaaaagtcaataaacccttctgctaaagaaaagtaatcatgcagaataaatctgtaagactgttgaatggaaagaaaaatatctggttctatttctttacacatatgctgacttcaatcttagaccatcataaagcacaggcagaacttgagcctggggccccacatggcaaagttcagtcctgtcaacacgggcccctgagcttttaaaggccttgtttgtgaagatgagtgttcacacatgtactttgacttgtatttttctcaaccttgagaattctggttccagtgtacatgaggtttagggcttttctgccgaagaaaattagaaaaaaagagttgagaaaagtaaagctaaataccagaaactagtcccaacacattttgttgcttattttgtctctgttcccctgtcccccaacccctctctatatacataaatatggtggcggtggtggggacaggtaggtagagacagatcaggaaacgtgacagagagtgagttagcatgtcctgctggcacgaacctagcctggtggcactgaggcctccagccttgtgtgcagaaggaggcctcaggcaacacctgcacagtcagggtgaaaggaatcaagacagcccaaagcatcttttatctcaagaatctatctttttgccatacaataagatgactcccttgtcattaattctcaaaagaaattaaatactaagctggaacactcgagggagaaaagactctgaactactgtaaaggtaaataagcctacgagtgggtcacccatccacaggagtggagatgctgggagttgagcaaaacaagtgcaatcacacaggcagtaaacagtacccgcactgctcatttgtattcttcctagtgtccctttctttactgtttcctaggaggaaacatcaacattgtttaaaaactttgaccagcaactattttccttatcccatttccctcccacaagatcttaaattcctccagcattagctcccagtgaagaaggcttttcaggatcataaactctgcagtttggtagactccattgtgttattgaagtgaagtgtaggggctcttcaagttaaaagaaagaaatacttacgaaaaacatacacttggccagactgagaagttctatctgggaagactagactgcacaggaaggcatgaatagcttttcagaaagagggaagctggaacaaagtgatgtttcaaggagattaactaggacatagctgcagtaacaaagatgtatgcaaaatttatcagtatataggtctagtcctagcaaaaatctagtcctcaaagagcccacataacccagcacaaggaatctgaaaagactgataccaagatgcatcactgagaatatcaaaatatctgtatcaaagatgttacaagtttccagggagtggaggccatacacaagggctcaggaataagaacaacatcagaataaattagtcaagtcaggcctctgtgacttgcggtgtgagtgtggacaaacccccattgtaacacagggatggtgacagcaccacctccagagcaggttacgggtgtacatgagacactgggtgtgtgacccataaatattcttgagaaggggaggaacacaccagactttttagcaataaaagctaaaaagaacaccttccaaaatacaagtgaaaattattttcacacttgaattctatactcaaactgttgagtggataacatatattttacaaagacatgcaaaatgtcaaaagatgtatcaccttccgtgtacccattctctggaagctactgcaggacatgactgaccaaaatgaggtacaaaacaaaaaagaacaagagagaaaatatacaatccatacaactggagtcagaacctagaaagaggccttgcacactgcctctgctgtgtgtccgggccacactaaaatggctgccattccacagctgccagacccttcaggactccttaggccagcaccctttttcccttcttgctaatttcatctgcaccctcctcaagtcagcagtgatgctcctagcaggaggtatgtttgtcattgcctctgagagtccacaggttagatgccatctgctgctgcttccacaacactttaattatatttatgtcatggggttgcacaattcatgttccataggccaaatcttacccgcctcttgattttgtaaatcttcctagaacacagccacgcccactagtttaagtataacctatgactactttcccatgacaatgttagagctgagtggctaggatagagattgaatggtccacaaagcctaaaatatttactgcctggccctttacagaaagagtttgctgacttctgctctactgcttcacttcctaatcttataattctccctacagaccgtcagatccttgagagcaaacacatccgagttcactgtaaccctcagtgtccaagcagtacctggcacaaagcagacaccaaaaactctaagccagctggctgaatgaataccaaggcacaaattattatatgcccacacagtatactttcattgttaggctgcatgctaacccaggtactgccaacactaggaacccaagttaaagctctggctcccaaactgcactgaggcaccccaagacaccaaagcaaactgacagagctatcacagaatatctaagtttttgaaggaaataaagtgacatctgtccaacactctgaaaaccgttagttcaaggtagtccacagtttcaatatttgctcatgctacatttttttgtgtgacatcgtatctttatctttggtgaagagagggagggactagtaattgctgggataaaacacaagtactacccaaacaaatcaatgtagaaatggaaatgagggtgctggtttccaagatttgggaagctatgcagtactcaatagcttcacacatctcatcagtaattaaggttttttaagaatgaaataaaaatactaccatagacccttcatatcccagggttctgcaaccacagattcaaccaaccttggattgaaaatattcagaaaacaaaaccaataaaagacaacagtacaacaataaaaaaacagtaaaaaaaaaagtaccgtttaacaactgcttacatagcattaacactgtattagggatgatttaaagtaatctagagatgatttaaatcatatgagaggataagcacaggttatatacaaataccacaccattttatattagggacttggcatccaaagattttcacatctgtgaaggtcttggaacgtgcccccacagagatagagggacaattatatttttccttttaagtggatacacgttatttcttcaaactgctactaaagtgcttgatcataaatactcattaaattgtttggacccagctatttcataaagagaactgttaggtaattcttttgactacaagcatcataaaaaacattaacaaaacacgacgggcactgtgaactatgacagtctggggacctgagttagaggatagcttggctgcttagggattccactgtatcatacttcaatatgcgttctgcatgtaggaaaataatattgaaatttaacatttgctacattataaagacaaatctatcactgtgcataatgcaggatattcattccccaaaataactttttggtctattattcaaatagaataatcttgtcaatttttttttcttaattcctttgcatttcctgggaacttttaaaaatagactgtcttccaaagtttttctttttcaggatcctccatgtcagttttagtaatctccattgcagtgtggacttccctgttaattcaagagccagtccattatgaacctcagcatgtcaaaacaagtttgaatacatcacttccatgcttaaaatcctccaaaggctctccactgtttcaacacacagttccagttccatactgtgggcacagcccttcgagacggccatgaaccccttcctctccataccgcagcagctccccaaacactccacattccctttggtctcaaggcctctcccaaaaccactgcctccaatggagtgccccctgcaatgtctcctatatttcccattcttccatctttcgggactcacgctatcatactttagagtaacatctgactactcatatcccacttcaactacgctataagagtgactggtatgtaacagtcttcaataaatataaaagtctaccaaacgaatgaacttgtttcttcccttttaacgatgaagtgctctattattaaacaacctgaagaacattcctccaataaatctttaacatgcaggaaaacatgacgaaaacttatctctaaaaagaaacaggaacatctccatttcccagtacttctcactaataccaaggattgtctttaaaaaaaaaaattattctgttgggccataaatggcatttctttttattgcgtaattaaaatatcctttcatatgtttattgataatttgcaatgctttatttataagctgtttattctcttttgctcctttttctaattgggcattaatcatttccttaatgattgctaagaaaaaaaatcttaatatgcatattaactctgttacatacatagcaaatagattccccaatcgcttttactttccagtgagtcttttgtttaactcttactagatcagatttctctattttgtcctttgtggtttctaaccataaaggtttttctcatgccgggactatgcaaattgtcctgatgttgccttcaagtacatttaaggtgtttcacattttaagcttcatgccatataaaattaatttcagtgtacagttgagtcaaggacccaccttttctgtttccctctaagtggttaccacttatcccaacaccacttattaggtaatccattccttctctcactgacttgagatgccattcagattctattcctacttagcttccttggtgggactccttagcctactgctccttctatccttcacttcctgactgaacagtattatctgtgcttgtggctataacatcacttgtatgctaattacttccaaatccgtgttcccaggattggcctcttcccagttacagattaaccattcactagacaatttcttgcttacttagacaaatccactcaagtaaggttccttcaggcatgacaaaatattctgatgcttcatatccacttggatatttcagattcctcaaaaactccagatgtactgaattaagctcactttcccctccaaacctgctctcttgtagccccgtcttagcccatggcaccagtgtcttctgagtaaccctgactcttccttcttcctcacacctcccacctgacttgccacttttacctaaaacatgccttgactctttccccatcctctccctccagtccatttctactgctctggaggctgaggccctcctcactctctggcatacgtaatttacaaccctctggcaagggcctcacacaatccatcttccatagtgagttgcaaagctttaaatagcatctatatcactaaccctatcattctttgaagctccaggccaaatatcagaaggctggcccaccaacagctcagacaaccgtccacactaaaattcacacgtctattccgcaatcttcttccacctcctctactcctttcctaggggcatctcttcctcttggttctctcttttttttttgagacggagtctcgctctgtcacccaggctggagtgcagtggcgcgatctcggctcactgcaagctctgcctcccgtgttcacgccattctcctgcctcagcctcccgagtagctgggactacaggcgcctgccactgtgcctggctaattttttgtattttttaggagagacggggtttcaccgtggtctcgatctcctgacctagtgatccgcctgcctcggcctcccaaagtgctgggattacaggtgtgagccaccgcgcccggccttcctcttggttctcatgctgaccactatgtccaaccagacacagtgctctgtttatgctcccactggacatcaatttcccctttaggcattgttcttatcataccaggtattatggaaatcattctctcccttccttccaccctcttttccactataagctaagatcagagccttatctttgtaaaatccatagtctaggagtgctttatatccaccacacgtacaagatttatttggtgactgaagcaaatccattcaaatagagtcctcggtgaggacttaaaatattttcataccattcagttatttgtctacattctgaagagtaagctgacaaactttatgcttttcaatgaacctgtttgctatacaaaaattcattaataaaaagaatactggctcaaattgaagtttttttggttttttggggggggtaatacatagagtaaaactatccctaaaggcctttctaaattctaggagggggaaaaatactaattacacaataattctatctaggtaacaagctggttttagctaactctaccatgtaaaatataatttatacatatatttcagatattatgcattatttaaatactgtttattaaggagcagccacttttctaagttctttcaatgaaaaattggatttaattttcatatcaatcctataaggtcggtattattcatattatttccctctttttataataagaaaactgaggcacagaaaggtcatacagctagtaaggagcaaagtgggatctgtagccaactctgactgcaaatctcagctccaggccattatactaaactgtaaaatgagcaactaagctggagtcaggagtcctggactccagtccctattctaccactgaataggtgacaggtaggggctcgcagataaatcacctaacatctcaggtcttagctctcaaattacacaactaagacccagcacctgctttccctactttaagtatcataagaaacttacggttgttttgttttcagaaaaccttgtttgtcacctgcaggaacaaactggtagatgtacaatgtgattagaaattcagctctcccccgacctgtccggtgaatactgttgctgggggaaacaccacctgctctaccaagcacttccactaatcacattataacaaagatcagacagtctatgttcagagaacaaatggaaaataactgccatcttactgttctccttccaactctaagtacacttttaattggttaagctctcaactcagcaggtgcaaactcaaacatactccaagagccagccagatgaaatgactggagccattcacatgacacaggctggcgggcagcccctcgccagctccttgtgtctgtattacaccacagaggacgagcggccagtacagccacagatcttccagtttttccaaaagggcaggaaatccaggttgttgcttttttagttttttttattattattattatgaaatatccttatttttaaatgctggcaattaattccaattaaaaaaaaaacactatgtgggccaaacaaaatacatttgcaagccaaatatagttcttagggagccagttaacctgtcacaaaatgtactggcattaaaaaattcttgtcttgctgctgaaataatcttaaaatataaactgttttaagacctagatttcaatgcacagatgttgaccaaaatgtgcctgaatgctttcttaacattctttagggtcagaatctgaagctttccactccaaaataattcaaaatttttttctttatgacattatttaaccccagatatcaaaatcttaagcatcatcttagattatgcttctcaaaacaacaactaaaataaagcctttagctctggcttcagaccacggtctacaacatctaagcaggtgaaacatcttctatgtaagagtggaacagcatatgaaaaacataacagcacctaaaataactgatatttggcaaagctatttcagaaaggggcattcttgttaagaaataaaatcctacagacacagaggcctgtgagcttgataactgatcctggataagatgatcaacagtactaagaaaggaatcctagaaaacctcagacccatgcacgtcagcccatccttagcctcgacttgataagctgttgtactgggaaaagcaaggatcagaaacaacaaaatgtatctctgtttgaacaaaatcttttctaatacatgaaagatgagtattagcaaggtaaagaaattcaagctgtgtaaacagagtgaagaggctgcttttatcacatgatcaaccttactcagagtgctaattcataggatgatgtcaacctggacaaaagtgatatagacagatatcaaaaacttctgtttttcttggtatcttcattaatgagttgcatgaagatataggaatcatatccaacttatctgtggatggaaaaaaatgggcaaaatagcaaatatacagggtgtaataataggattctaataaataaatccaataaaataaattcagcatggatgtcagggtccaaaatgaaatgataatgttgataacaataacacacagaaaatgaacaaatacagatgggaggagatatgatttagcagcaacacacgggaaaaccacaaaaaaaggttaataagctgggccaatattgtaagatggccataaaaatattaagaaggactacttttttgtcttctcactttatcagacacataatgtctaaaatcgtgtcctccagtggtattaaaattggaggattcattttagtttgaaaaataagtagataatctaatatcaaagtattaacatgaaacataaattatgattgttggttttattactgcccaagtcatcataaattcttgctcaatgtaaatcttactctagtaaatcccatctcaccataagtgccagctactacctatttcatagaagaagtacccacatgtggggacacttgaacgtttagcaacttgagggtaaggcatcaataaatctgtgtttgagagctttaaataacaaatccttttttattatgtaagtttaatcagaagctttataaaaaggacatgatagaagacggtagaggcagcatgatgcctctagttatgactaccacttgtgccactccctcaactttaccaggtaaataaggacaaacctccagagtcgggcctagttggggcctctttccctcagcctgcacaaaggcaatgcttctaaccggtctcaggacttctgatcctcccatagcacaaattcagttttgtatgcctagaatcctccatggctctccctggcctacagggaaaggtcccaagttgaacagggcatgaggctctagctttttcatgccagcctaagtccccagtgccatctctgtgcacctcctcacagtggccccgtgcttaagttccaccaaatgtgtaaacatgtcaggctctgtggtgcctcagtgttcccgcacagacagatcatctacctggaatgtccttcccactccactcttccttgtccctttaacaaatatcaactcgtccttcaaatttcagtgcacactgttccaaatccaaccttccccagtgttctcaggtcgtaatgcatatgcttacattactacatataatattatatagcaatgatttataaaaccatctttctcaccaaactgagcacaatgaagattttttccctgggaaaaaatatgtgcaacaaatatgacaagtgtcactatacttaggatatacaaatggctaaaaaagatgctaaagcaagatgaataccttcaatagaaataaaaatatgcaactcacatactaagaaatataaataggcaataaacatgaaaatgacgtgaaaccatatttctactgattggaaaaggttaataagaatgatactagatactaccctggacaatgtggagaaattggaacccaacctgtagttgtgtaaagccacaggccacatgctccagggaggcccaagcacttaacctgtactctctcaaccctccaaagaggtttggtatttttcacatggcatgcatgaggaaatagattaagtgacttatccaaagtattgtggctcgtaaggagcaaagccagaatttgaacctagacttgcaattatgactctagagtctgaattgtgagccattatgttgtctttccaattgaaagcctttcactcaataacagtaagaatgatgaagataaaccaaggctacaaatatttatcaagagctcactatgtggtaggctccattcaagcacttcacatgcaacttatgatctacttctaggaaattctcctcaggagatatcagacaagatttcaaaggtgtgttcactaaatgcacttataatttaaatgaaataacctgaatgttcatcaatttgggattgagtaaagaagatgacatctctgcatgcattccagcccacttctctctttctgtactcttaataatttctcaatcatgttaattaaaatctatatgtggtaatttaaaaatttatcttacccttccttcctcccagatttatatgccactttctacctgacttttctccagatatacgtacaacttgtcacctggaagtctcataggtgtcttgaactatgtccaaaactgattgattcataaccctcctaaatttgttcttcccctaacctacaccctctcaaaatatagctaatttattcaagcaaaaaaacctagcagtcacccttgagtcattcctttccttccctatcggcctctacccactccccatgtactaccagctgctacaccttcaaatgcatgccgaaggaaaaaacacccatcatcctcattgccacccccaaattaagcgcaccaacctcttttgcctgaactgctataagagcctctgaagtggtcctcttgtttccagtcttgctccccaccaatccactccgcacaaagcagaacctttcaaaaacagccatcagatcatgtcactccccagtttaaaaccgtctagtggattctccttataagcacaccccactctctgtcctgcatccccttccacactcttcacatacacgtctctcctttggtcaccggcttccagtctcctccagggccttcttccattcctcacatgcaccaagcttgatccaccaagggccctggcacttgtcattcctatcatggggaatcaccttcccctgactcttctcatcattcaaattaacactcacttcctcaggaaggcctctactcatcacctagaaagggggacaattccctgcttgcctccctcccccaaatcccgcaccacaaccacacactgctcactcttccttgtggtatcctattttatatccttcagcgtacacatcaatacctagaggtatctatgcatacataattcctgacttattgtccctccctccccacctagatgctgagctctatgagtatccagtactgaatatccagcatgacctgagagttcagcataggtggggaggaagagacagagagcaggctcctgttcagcactcctcttcagcgctatagcccccaagagctagaaaaactgcctggcacacaaaaagtgtgcagtaaatatttgttaagtaaactgaataatggatgaataaactgaatctagtgtgcagttatgcaccatggaagattattaatataagttaaaaaacttaaatcatggccaggcacagtggctcatgcctataatcccagcactttgggaggctgaagcctgtggatcacctgaggtcaggagttcaaggccagcctggccaatatggtgaaatcccatctctactaaaaacacacaaattagccgggcgtggtggcggacgcctgtagtctcagccactcaggaggctgagacaggagactcacttgaacccgggaggcggagcttgcagtgagccaagatcacgccattgcactccagcctgggtgacagaccaagactccgtctcaaaaaaaaaaaaaattaaatcatgttacaagacagaatgtacatacggtttaacatatttggagatgtagacataaatatatgtgtgtgtgtgtgtatgtgtgtgtgtgtatacacatatatatatgcacagaaattaatctagaaggatatgtaacaatgttgcctggggttatctctgaatggtgaaactaaaatttttttttgtatttttacttatattccctgagcttccttaatttttataaaatgagcatttttacttttataatttttaaaaagctacttatgtttaaaaaaataacaatccagggcagggcacggtggctcacgcctgtaatcccagcactttgggaggccgaggtgggcggatcacgaggtcaggaaatcaagaccatcctggctaacacagtgaaaccctgtgtctactaaaaattcaaaaaattcgcggggcatggtggcgggcgcctgtagtcccagctatgtgggaggctgaggcaggagaatggcgtgaacccgggaggtggaccttgcagtgagccgagatcacgccactgcactctagcctgggtgacagagcgagactccatctcaaaaaaaaagaaaaaaaaaaaaaaaagaaaaaatccaatgtaaaatcaaataatggataaatcacaaaataaaaccagctaataaaatgaacaaatattttatttcctagtattcaaataaatgtggagaaaattcaactgtatcaaaagtcttaaagatatttagttgttttgactcaataaaccaattttaagggaagaatgtgaaatttattggagaaggggaaaaatccagctttatgcttaaatatatttactgtaactttaattacgaactggaaaaatttaaaacaatgtaaatgctcaagttatggttcatccagagaataaaatgttacacagtcatcaatacatactaaagaatttttagcaacatgaagaaacatatatacgccattacatgaaaagataaggaacaaaactgaatatccagtatgacctgaactatatgaaaaaagtgaaggaaaagatgggcaaagaaatgttacctaccatagtttaaaactggcaggctttgcctttagatgtgttttgtttgaaccatatacataaaaaaaacaaaatttaaaaacccttgaattatttgtcaatattgcaaaatggagtgtttaaaaatcaaaattaagaagctctggaaatactcattccacatctcacaggataacaatcaactccaggtaagagcagttactccttcctaagaacatgtgttctggagtttttcatagttctcacctttccttactggtcttcaaaactgagacaagttccagttgccatttaccatctagattgtcaatgttgtctatcttgcagtagagttaaagagaaagtgatatatttctgattgtctctatatcaaaagcataaagacaaaaggcaggacaggcccacttctgccatttatgtaacgtccactgtccctgtaagcatttgagtttttgatcccagcaatgcagcctgtggaatgtactgagttcagcactcacagctttgactatttgtgagctgaaaaagtttcaaaacagtcatctgtaattttattgaagctggccttcaggaaagggtgagttggcaaagtcctaagtctagccagcgacccaatgtctacatgtcaacacagcttggttgctctccagtcaccattacatactcagtgcagctcatacagtgtttctttgtgaaaagtaaatccccaacacccccaaaagaaagctaactgccagttccagtgggggcaaggggagtaaagtccatgtaaggcaatggtatggggtagaacaatgtgagatagaagtaatatgtatctatatgtacaatttgtcacctgcaagtcttgtcacctccagtgtgacgagatagatagaatacatatctatatgcacaacttgtcacctgcaagtctcacacgtatcttaaactgtgtccaaaaatgattcttgattcataactctcctaaatttgttcttcccctaacttacaccctctcaaaatatggctaatttattaaagcaaaaaaagaagtaaaatggtgactttgctgttggttacacaacctgtgatgtaacttatcctaccatgaattctacacaggaacatgaaaacatgactcaagaaattttcttttttttatttggccgtatgaggaaaataaaatgcaagctcagtatttgtcatagattccaagacgtatctttcacgactactgagggtctacatgttatcaaaatatttagaacagttgccaactttaaaaaaaaagtccctacataaaactaattacaaaactaatgtagttttacacactgtcaaatggagacattatttttaaatatagtcacgtgtgcttaatgacaaggatacagttctgagagacgtgctaggcaattttgttgttgtgtgaacatcatagagtgtacttacacaaacctacatggtatagtctactagacacctaggctatatggtataatagcctattgctcctaaggctataaatctgtgcaccgttactgtactgaatactgaaggcaactgtaacagaacggaagtatttgggtatctaaacataaaaaaggtacagtaaaaatatagtatcataatctaatgagaccaccatcatatatatggtctgttactgacctaaacatctttctatggtacacgactataaatgctttattgccactctctctcagtaagatcatgtgctagaatttctcaagtgggatagccataaattccatgcatcctagatttgctaggaggagctcattttcaataattttacaaaagataatctcaaaaaggcatgaggtcatacttaagataatgaaagattatccttcacagaagatatatagtagcaattttaagcctattaacctaggatattctcacacttgtgtaatgtaagtcatcactaaatcattcatgaatgtcaacgaagtgaaataacctagtatgttcctcatatacagtagtttgttgaataagcaggaggcaatgtttgtgttcagtaagatgtaacatcacaacaaaattccttttaaaatcagaggagagaaaatgagaactacttgatacttaactgcagtaactatctatttattgagtgggcctcctggctttgaaccacattggtcacttccatatgtcattcacagggcagagacatgtgggtccaggacactgctgcaaatctgatgcctacctagtgcctgttaaagaaaaggcactcaacagtgacttgaatgactcacatcccactctaacacctctataaaaggaaagaaagatcagaccctgaccttcaaaaatttatacaggactattcaagacaacaacagaaaaagaagaaaaatgccttcaattcaaaataaaatgtattggcaatggaaggcatttcagttttaaagtaaataaaactcgacaaagtatttcccagtgaccagaagcaacaaaatagtttgtcagaatgccctgaaatgctttccgtaacagtttgataaaacttacataacacaattattctgcttggaaattctgtattaagaatagaatactggctttaatcaccatatcagatcagtgagatcaaggtaacgtttattaaatactacatgtgggcaccgtgagctggatattattatccccatttcacagataaggaaatacaaaacttgcccaagttcacacaaccagtagtagcaaatgggaaatgggatctgatccaagactcttcaccacacggcatgctttatgtgtgggaaatccaggaaagtaaaaagaataacagtcaattgtaatttccacacatgaaagacagtatcacctaacattcggcctatagtcttcctggcattttactacataatatgtagaaaattgtacacacacacacacacacacacacacacacacacactccataagcaaaaacaaggatcaacgtacccatatgttttacaatctgctttttcagtttacaaatattgagtatctttccacatctataaatattcccctacatcactgttaaagaaagggtattctatcacatgtatgcaccacaattcatttaatgagtccccctattattgagcatttaaggtgtttctagtttataactattataaacaaacttacaggctggttacagtggctaacgcctgtaatcccagcactttgggaggccgaggcaggcggatcacgaggtcaggagatcgagaccatcctggctaacacggtgaaacgcatctctactaaaaatacaaaaaattagccgggcgtggtagcgggtgcccataatcccagctacttgggaggctgaggcaggagaatggtgtgaacccaggaggcggagcttgcagtgagctgagactgcgccactgcacgccagccagggcaacacagcgagactccgtttccacacacaaaaaaaaacttacaaaaattatttttgcaaattagaggagggtttttttaaatgtattttttttgtggtggtcactagaatctggaagtgagttttttccaaatttcagaggacctccctccagattttggtacatcccagtaagtaggcttcttaagaatcactgcgaggagaaaggtatcgacaggagtatggtgcacaaatgcactataaccactgctaaagactggtcactgtacacatactttatcgtttctcctttgtttacattgctagcggtgaacatgcctgactaagggacggggcacatttttgaggcttctgatgagtaatacaaaattgccctcctgtaaagttataacaattgaaacacccaccaacagcatttgaaagtgacaatttccaaaatcctccagttgattagatttggttttaaacaatcatatccccatatggccataaatttttaaaatagctgagctattgataaagcacaactgaaaaaaaaacagggaaaaattcaaacaataaatgctagattttaaagcatctgttttcaaatacaaaatataaaacttaatgataccagataccagtaggctgaacttaacagaatggctttagaaaatccagtgataacagactttgaaaggtaccaagctaagatgtaaaacactgcaccttcgtttgcctgtctggcttaagagtttgggttttaatagcaacatgctctatttttctaacaagaaactcataaaactgtatattctttcagattgtataagtactgtcttatagctaacatggcaatctgaagttcttaaaattcctttagataatcacttattcaacaaatatgtgaacgtctactatagactaggcactgttctaatgctagggacacggtggtaaatctcgcaaaagttcctgcccttgaggagctgttggttctagagaggagttgagaaccctgcacttaaagagtccgaagatcatggttacactgccaatcaggactcctggattcttcggcaaattataacaccacctctgggtctaagtttctttatcttaagaagctgaccagatggatctgaagggccttccagctttcaatcaagttatctactttacttgatttttgtttaagtgcttaattttctattattcataagagctatgcattttaagctctaaatagtttttccacaaaatcagactctcccaaaagaacaattttacatttacagtaaaattgtggtgatccaggcaacttcaaggaataaatgtagtcatgatgaagttccagcaagaagaaaatgtatgctcctaactttaactgtttctatggagatgtttttgcaatggtcttgcctccttcacctttgtactgcattataaacactaaggcatgaagcatggcagggctatgggtctccaggcccgttgcatggaaacagttggcatcctgtccccatgcagcaggcgccttagtgcttactgtggcactcgggtgtcctcaggggctgcagcctaaagtcctggtggcgattctcatctctctcccactcaccttacctccaactcgacaggtacaacaattctgcctgaagtctacatctcactgccccattagcatttctgtcacctcttgctattttccaccagatgttccacaattcaacagtcctcggattcaaggtgtctttggagaagcccactttggggagaagttaaaagaaggtattgcaagaggcctcagtattccaaggcattctctggaagagcaccacacatacactttaggtagtgatatcaccgccttgtggcctctaaggatactgccgcttagtaatatagcatataaacaatgattccaattctttctctgtatctgccttacaaaccagaagaatgattggaagccaagattttcacctctgtgcaaaagtatagaaaaaatccacctaccagaagtttttcctcaacttccaacatgaaagcatagaatagtatctcccaaacacatatctttgctcacctgagcagtaccagcagcaacatcctataagaatgcatgtgttgtcattttagacaacgtaagacaaatttgcaattcccatatttcacaaaaggaaaggtaaaggaattggtaaaagtactttaactcgggcatctaagcctctaaatttaccccaactggtaggtgtttctactcttttactgaagagcttttactatatcaggacaaaaggacacaggcttctttactgaagactgaggacctaaagaaccctcctttacatataatttgcacagaacttaagagaaacagttggaaataaaattgtcttaagtagaaactgcttattatgctaagttattaattgattaagataggaaataaaaaagttaaaaaccatcattctggaagatcacaacacttctaatatggaacaggagtccaaaagtcacaggagaaagatgtagattcttattagacatctataacaattgcttggcataaaactcatttcccaagttttcaattaatatttagaatgacagattagaagttgggaaaaggaaatgccacaaattattgatattccctatagggcaggcacacattcctcctgtgagaataaaagtacctacatatattttatctactcattagtctgtcatctggcccaaagaattaaaacattcaatacacacacccacacacaaaaggcatctttgaactcttacacttatacaaatggctattccacggaaataaaagataaaaatgctcacctttctgaaaatctctcataaatcactataatttactgaaaaggtttgtttttaaggttttacacttgaatttcatggaagagcagtcaagtgtaattgacttaaagcaacagtttgacaaaagtgataatttgaaagaaaagtgataacagtataaccgattggctgatgtcaaaggccagagccaagctggaaaactaaaagactcccgaatctaagtattttgaccaaaagcaggtaagattatttcgtaaattctctaattattcatttactcaataactattcatagcccactatgtgatgaaggtggttcctggtgctgcaaatgcaatgggtaacaagcagatgtgttgctagccccctggagcttccagcctatagaggaactccaccactcacatctttcccacgtctgtaaacatttcttgacatgcaacacatatgggcaccaaccccagcccactcttcttctgcctgcagctctctcctttcctttcaccaactccagccacagaggtggtcctctgtccctcaggtatgcaaggctcagtcctgctccagggcctttgcacttgcccttccctctgcctaagccactcttctttcagatctccaaaatcataggcttcttccccctcattcaactctcagctcagacccctccaccccagagaggcttctcaggccacttgatgtaaaacagcagcccacatcctgtcccattctgccatgcaaccctgattgctttctttcacagcacttagcactatctagtcaccatcacttattgtatctttgcttcttatccatctccttcgctgagattatagcagggtctgtctgtcctgtgcagtgccataatttagtccctagaaagttgtctggaatattaacagatgcccaataaacacctatttcagaaaaaatacagacaacgttagcagttttgtatcacaacagtaccaaataaaaggcaagagaatgccttaaattctaagaggagtttggaccatttaaactatatatatatatatatatatatatatatatatatatatatatatatatattatatgtatgtatatattttaaaagattatgatagcttacactagtcctaaaagccctcaaaaataagcataatgaaaatactgaagctcaacattggctaatgttcaagctttataatgtattaggctcaatttctagcattagcattacttttacaatttattctttttcaagagcatgctgacgagaccccaatttttttgttttaaagaaaagcaagagctaagtatgttttaaaagcatccatccccttaaaagttattaaccccatcataaactgtaaaatctgtaaccatattatactaacattaaaatataagatactggtgataatctacagaaggcagggatttgagtgcctaatggcaaccgaattttatgaaacataaactaccctcatcttcaatttaatcaaaggtacaagctgcctctctacgttcaaaaatatttaaacacttaagaatttttcctcagattattctttaaaatgtgtatctgttccttcttttcttttgttaaaacaaagagccaagttgttacccaaggaataatgactttagttactgaccatcatggctcccacttcacagcaaagatgccaaagactcttatggattactgtgaagttatatagaagcaaacagtgtatgctggggagaaggcacacttatttcctggaaggtgatataaagaaacaaatgactactgcctttaggcctttgggaataaccaaatccacttaaaaacctcaaaaactaatgctttacaatttcatagcaaattattagaaacaacctacatatatcacaatgaagagattaaataaattatggtccatccctaatggagtactcagcagctgttagagaatgaggcagattctcttagataccaatggagactgccatgatttagtactctggggagggaagcggggcagggggagctggtgcacagtatacaatgggtcctcatctttaggaatacaaacaaaaagaacacgtacagaatgtttacatgagcataggctatgtctggaaagacatacacaaggagccagtagctgtggaacatgatgggagagaggtatactccgtatcttttatatctattgaatcttctccagtgtgaatagattacctgctgcacaattaatgtaagaaaaatgcacactattaccaacatatttgtcaaggatgaccattcagaagcaaatttttcaaaaatcacaaaagttttgctccttcaacagcagagtccctgattctcattccccagaagagaatacaagtctccactaatcaagaggcttgctagtgatctcactcacctattacaaagcaaagaagtctcaattcaattcttgaagaggaaatagctgctccgatcaccttgggaacacatcatatatttaaattgagcttgcaactaactccctaatgaagtttccaaatgaacagttgcccccgactataaagcataaagtcaacgtagaagacaactaaaagaatggtctcgtgtttttaaaaaacacattatacttaggcttccttttctctgccaggcttagacaagaaactctctggtaacagtgaaatgtaatttcagatctgtgacaaaataatcatgtaaggggaagggcaagtagcattcgcgctgaaaaaactccttggtttttccacttgtgaaaaggaaaggtttgccttaaatttaatttctgtaccatttctggacccctgcctaaacgatactactatatcacattaatcttacttcaagcaaatactttttaaaattaaaaactaatctgaaactgaacaggaatcggaagacaaactttaaactgaaacttttctgttgaaagaatgtatcttttaaagacacataaaaagaaatgcaaagaaccgatttccatataaatgccactcaataacaatacaggttataacaatatttgactgcattaaacattcaaaaaggaacacaaagatacccaactgcaaataaaagacctcatatatttttggtagcggaatgtggggggtggggggcaaaaatcacattaattcagattaatcatgtaaattcagaacacgtgatgtgcagttttgtgtcgctcagaactcctgaatccagctttgtgcttttacacaacataacagaaatggcatctttcacaaagcctaactttgacctccaacactttaactttgggtttaaccagtacaccaccttcggaagttagcacataaaaatacaggtaagtcaaatgcactacggatacagaaaggacgaggaacaggtttaaaggggagttgaagcagaggggcacgaaatcacctggcaggtcacctctccgaaggaaaaacatttcaagctccctcccatcccccaggtaacctctggcctcagaactcactgccctgcgtggggcagaagttctgggcgctggagtccgcgtcccccaggacacgagggtgacccaagggcgcgcggagagcggcgggacccggagcggcgctctccggggtcactcccctaggacgctccgcagagctgggagcgctgccccaccccgcccgggccgcccctggggaccccgctcggggctccgcggctcccctgctccgcgccgcgcccacccgcccccaggactcacggtacgctcccgcgccgctatcttgccatcccctgccgccggctctgtagcctcggccgccgccccggggctgcccagatcccacagccgcccgggggcaggagccgccaaggagggggccgggcacaatgcgccgccgcctccgcagccgccgtctcgcctcccctgtgtcggcgcgaggctgcttgaggcggccacgggcgaagggcggcccgctgcgctccgcgaaccccgcgggccgccgccgccgccagagcctcccagaggcaacggtaacggccaccgccacggccgagtcgctccagccgggactgcggcgcgcgggggcggcgcctgcacgccgctcggctgggggcgcagcgggcccggccccgcccctgacccgcccctgcccccggccccggccccgccccaacccgcgcgcccccgccgatccccggccgcgcgcccgcgcgcgcgggtgctccaaggagtcggaggaacgcggccgcgcgacgggccccggacgccgagggtggtgcttcctccgagcctccggtggtgaggccgctctcagaaggtcatggaagcgcaggggagagcgaggcggccgagcccaggcaaatcctcgagaaaggccgagtgcgcgacggctctgcggggaggaccgcgcctccccgaatgcggccgctgctgccgctgcaaacagtgccttgaggagaggaaagcggggaaccgtgttttcgccgcctctgtaaccactgcacacaagaaaaccagcttctgggagagggggatgattgttgggactttgcgaattacctaaacagcccagggccgaggcgccgccgctcgcgtcctggtcctcctgccgggtgtggggctcccctgcccgagatggccagcgggcgcgccgagagtatcctggagccatctagtcttgcctcggaggcggggtgggcttatttgtgcggagaagaaacggatctcttaatggggtgagatttttcctccgtacattgttcccatttccgcagtttcacttggcctcggttttctagcagagtaatcaccaaatgaaattagctggagagcgtttgatggcgcagaatcacggtctgaagatgtttacgctgtatgccggacgcgtttgatggtgttctcttcggcacaattaattttgcaaagttcagaaatgtgccagacagagcccctggcacgcagtcaggactctacagacacaccttgagtaggaaacaggcttgtttgtttcatctgtgatttatgtgatgcaccagcaccaaggccaacgtgttttttaaagacctttcgatgaaactccaaagcaatttataaattggcaaaatgaagcttgttttgtaaaataactcttccttgttgatcatgtaattaaatgggcaacaaaacacctgaaaggacatttactgaaaagtagactcccaaaacaaaaatatgtatttcacagctagatacggtcgctattagcgtcctaatggccaactccatccatgtgcgtattttgaacactaaaaacgcctcctgttacccctaagaccttgtttggataacatttttctattataagtactcgaaaccaaccccatttaagatgtttacccttattcttgagtccttgatggtttgggaaatttatcattattcatattgcacaatcctgtcactgtcttttccattaggcacagtgcctaaggtccacaatatttttagaggcccacaaaaaatattttaatttcttttcaaatcagaaggaaaaaaaatttaggtttaagaaagtattttaatatatattaatatatttgtttttgtgctaatacaatcttaaaatgtatgtatatatgtgtgtgtgtatatgtatatatattttaatggagtaaggggctcaacgaaggcaaaaaggcctagagcccaagaaaaacatgatgtggccctgttgcctggggttgaaaaatcccattccatgagaagaatttagttttaagaatattacataaaatgctcatttctgtggccttgctataatagaaagatggagattcagagtagtgataatggctaacatccacctgatacacaccatgtgtccattacctcttaatcctcacagcacacctgtgaaataggtactattctcacacttagggggtaatgcaggttttgtggggcctgcaatttatgcaatttgggtggtcctcttaaagaaaaagcaaatactgtgtattagtccgttctcacactgctataaagaactgcgcgagactgggtaatttataaaggaaagaggtttaattgactcacagttccacatggctggggagacctcaggaaacttaacaatcgtggtggaaggagaagcaagtaccttcttcacaaggaagcggaaagaattgtgagcggaggaacttgccaaacacaaaaccgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtaagaaatttagggatttgccacagcttctaaggaacaccacattccttacaccatactgaggtacaatttgaagagttgcggtatacgcactgtttcgtgaggaaaaacggagtttctgtaacaaagcaagagctttaaaaatatgttagcaatatttgaccaggccataacccagcttggggcacctgactgctgtctgtgctgtcaagaataaatttttcttatctgttgtataaaaatctgaattaatccatatggactcctgaaggaatttcagctcaatttcaagtctcatggattgagactatttttacttactttgtcatagaccagtctgtgttgtaaattctaatttatataatatttactttttgcaatttcatgaagtgttgcaaaataagtatcagaacaagaacgtactttgtttgatgcttatattgcataatacaacgagccttatctccataagtgtttgttgaataaataaaataatgaaacagagtaagtcacaaaactgaagtaaaagtgtaggttttgtcacaagctaaaattgaatgggactgaagtagcaaaatgttgagctgtaagtacttgctggataagcagaattgacttcttagttaattattttgtgctaaacgtctgtgatcttcttcccagctactggctcttctttctgtttttgttttgataatttattttcttttttgtaaatgctattgcatttgaaatgcatcattatataataatgtttaaatgaaacaaaaatcatagtcacacctgtaatgaaagttctggaaatgaaacgctttgttttttgaacagatcaattactcacagaaacagcaaccttgagttgatggtggttttttcattaaatcacctacatcttgacccttaaacaggcttctctatgtgtgatctaatatatatagtgtttatcagtcagcaggagaagatatggctgtgttcctggaataaattttggaagcaaaaaaaaaaacattctacaaattaagcatagtttattaaccggtgaataattgaaatgagtgaaactttttttcattttaagcctgactgataaatgtagacttaaattggtttatttttgagcacagtgttggacaagattcaaaactttaattatatccctgtaacatgaagacatttgagagtaatcagataattttctctagattttatgttctttacccaaagtggtttggaatgctatttgagagacatgaaaaatatgacaaagaccatcaaaaatagtatctgctcaaaattctgtttaggatattctcttttagatgcaatgatttcagggtgctatgtcaagtaatttgataaattatatctctagcttggccccaacaggattgcattttgttttgttttgttttgttttgttttttgtttttttttttttaggcagagtcttgctctgtcgtccaggctggagtgcagtggtgcaatctcggctcactgcaacctccgcctcccaggtgcaagcaattatctgcctcagcctcctgagtagctgggattacaggtgtccgccaccacgtctggctaatttttttgtatttttagtagagacagggtttcaccatcttggccaggctggtcttgaactcctgacctcataatccacccacctcggcctcccaaagtgttgggattacatgcatgagccaccacgcccagcctgtcttttgtttatttataccgtgccttcttccaaaagggacttaaggtggtttatttacaatgaaagacaaatattttttaaaaaagaaaagttgaaattctggctgagacaaacaatagtatttgagcataaaactgagcccaagcttcctcatagcagtgaaataggggaaatgaaggtttgcatagctctcattgtcaagtggaaggagtcctacagtttcatcaggagaaagcctttcctgacccagtctctgggaagaatttgtcttaagggtacttacctgagcgatactcacatatccaagttaagagggacactacacaacaattttggctatcttttggtggcatacagagctaattttttttctggtgattaacttgaacattgctattgttgaaagtaagtagtgagactcttactgtggttgtttcgtttttgtttttgttttccctagcctttgaagtgaagccaatgatgtaaaatcaagtcttggttttcctagtttccttctctataaaaagggcttattaaaagtacctacctcgtagggttgtagagatgacaaaatgagttaattcctatcaaaccacttattgctatatcaaatttactgtagctttcctcagccaaggtatatatatctattttttcctcccctcttagaagttgtcttattgtagaccatctgaaatcccttttggaaggatgcatgtgtatgtgcctgacacaaagtaagcaataaatatttgctgtgaatgttatcgttattataatttctactaccactcctaagtctatcaaagctttgggagtaggagtgatggtgaggcagttctagcctccaattgtccttgcaaagtaaagcttagagaattatgaggagtaaattggtatcactgagatacccataaagcagtcattttccctttggttccattgtattgtttaccatcacctcctgtcctctatgacttcacttcattgtttaatttgaagaacatgaagtaagaacactttcccccgatacactaacatttgcttaactccctgggtcttggagacctcttatactcttgggaggctaaatggcacagctgttaaagccaactccctgagccaaaagcctagtgttggggatcgtgggagcaccgcaaatgtgaagacagccagtgacaggagggagggagacagccctaccaaaccctctctttcccgagtgaactctgtccatcccctctgctctgcccctctccatatggttggtcccaattaacttccatctgattggaatcttcgtttcagattcttactcttcctctccttaaggaatcttattgtttcccttcttgcctctcccatcttcttttccgcctccgtcttcacgtatacctcacttcttagccattgagcctccatccctttacctcttccttttgacttcctgagcattctcctctgtccctgcttttctttctgtccccttattcttatattcttattcttagctgttgaccagagtcatttagggaggcaaagcaaaacatttaaattgatgctaccttctttcttatagcccatcgtacatccagaatactgagctaatattctcaattaagctaatggatcccacaaaaaagcaatttactcccttttgagtggtgatattaagcccattattgaatgtattcctatgctactgcactcagtgcgttgccagaggcatcttgtgcagatggagaaagaagccaaaagattaagggattgagctgaggtccagccaggggtggtggagtggttcaaaattgaactcaaattccttaaatccttgaatatattattctaaatattgcacttaatccaccaccttcaatattatgtacaaaaccaaaaaacctaaaactgcaggggtgaatttttctttccagtttctgactgtgaagaattttcagtggttacacatttgccaataggcataattcaaggtctctgaaacactgggtagctgaaaaataactagtcagttaaataattaatttaaataacagtaatatccccagggttttcttcgggtacctaatctggaacactgcctgggtctcatattgggaaaacaaaagtggccatcactatggcagctctggcaaacagggacatttctgtggatggtgtttctactggaatttaaggtaactgaggacgccactctcaaagggaaagtctgcagcttggaattttttttctgtgacacgcccaagaaatcttgtgtttcaggctattttgttcccagggtcttggacttgaagggctgacagaaacctttccactaccctaatcaatgtagtatcccactcaaatgtgagttcacatagaattccattctacctacccaagtagtcttgacctggactataccaattagtctaaccttactgggttttttcttaactctagaaaagagaaacatagctgtgcaggtgactctcaggttgggagattaatattaattggttattaacataaagagtccccatgctaggcactttctctgtgttttatatatgtagatattagtctcactttacaggtgaagagaccaaagctcaaaggagtaaaataacaaagatatgaatgcaccagtctgtttaattccaaagtcatcataatttataatgatttagaagatgttggctaaaagtggggctcagaattcataatcactagaaaacattgaacatttattaagcacttacggcatgccaggtactgtgtaccaactcagcccatcctccctacaatcctgcaagttacagggagggctgtcatctccatttacaaatcaggcaaagaggttcactaacttgccaaaggccacacggttactgacaacagtgtgattcaaaccatggcagtctggctccaaagcccacactcctcattcctgaacgctatgttccacttcagtgctggccactgaaccttctcctgccacttctagtttcaggagcttcactaggatctcacctacaccgtagtgccgctgtgagtgaggctttgacaaagttgggttttgactgagtgctgtcaaaggctcttctcaacccaaaggacatgctctgaattctgtctctctttagtccaaatggctcctgtcctttgtctctgtagggttgaatctaactctttctctcctgcattcctgtttcagattgtattgctagttgagatagagacttgctctttccttcgggtgttgtttgagtgcagaattgtgtctctgtaggatcagcccatcccccttccccacactactcttctgctttgagaccccatgattggatttttttttttttagactactgcccaggctagagtgcagtggcaccatcacagctcactgcagccttgacctcctgggttcaggtgatcctcccacctcagcctcccaagtagctgggactacagacacaccaccatgcctggctaattttattttttgtagagacagggtctcattatgttgccaggcttgtctcaaactcctgggctcaaaggatcctcccatctcagcctcccaaagtgttgggattacaggtgtgagccaccacacccagtcccccatgactggattctcatactgctattcatctctggtgggttactcctttcttcaacctgaaagtgatgttatattcaaaaccaccaacagccgggagcatccctagacacttccattggctttagagagtgttatttttgtctccattggatttagagagtgttatacatatgcatatgtatatatatacacacaatatatatatacacacacactacacacacacacacacacacacacacacacacacacacacacatatattttttttttgagtcagagtctcacttgtcacccaggctggagtgcagtggtgcaatctcggctcactgcaacctacaccttctaggttcaagtgattctcctgcctcagcctgccgagtagctgggattacaggcgcctgccaccatgcctggctaattttttgtatttttagtagagacagggtttcgccacattggccaactgatctcaaactcctggcctcaagcaatccatccaccttggcctcccaaagtgctgggattacaggtgtgagctttcatctttattttgcacagcagtttagtaaggaatttgttgaaattatactagacttatattcagtattgagccttggatgtttaatactttatctttagaaaataaaaattttcagttgaagaacaaagcatatcagtattccattaatatagttttcagtataacagatataacagtgaaaattgttcaatgaagattcctttcctgcaagtggtagaaatacagccctcactaatttaggcaaacaaggaagggggaaatatcatgaaaaagaatattaagtcccaaatggcagcatagctattgcctaactaatttaggcaaaaagggaagggagaaaggccacgtaaaagaatataaagtcccggatggtgacatagctattgggggaaggtaaattcctacatgaaggaaggtgggaagggcagacagtgccttcatatgtccacaaaacatatgaaatgagatgatgtatatgagaaagcatcaagtggataaaatatacctctgtcatgattgttgatttttttttttttttttttagacggagtttcgctcttgttgcccaggctggagtacaatggcgcagtctcggctcactgcagcccccacctcccgggttcaagtgattctcctgcctcagcctcccaagtagctgggacttcaggcatgcactgccatgcctggctaattttgtatttttagtagagacagggtttctccatgttaggctggtctcgaactccagacctcaggtgatcccccacacctcggcatcccaaagtgctgggattacaggcgtgagccactgctcccagccccattgttgatttttaaaacttagtgttcaacaaatatttattgagtacttaatacatatgcatgctaaggaaacaacagtgagtgagacaaagccctttgtcttatgaagactctgatgaagcttacgtattaagactctcaaaacatggtcagaatgtccttgattagcctgagttgccaaaaaagaaaagaaaaaaagaaactattttaaaattaatttttattgctttctgtctttcattttttcttcctatcatagcactagatgaagttttagatataagcttaaaagcctgagtatttgatttctcaatgaccgaaggttaattacagctcataaaaatattagaattaacatataatattcagcctaaaagatataggaaatatattgttcctttgattttaaatccctttcagtggctcaaagttaaaataaagtttgcagacgtatcagttggtttaaaatcaatattttcttcattttaggcattttctatttgccattcaagggagaggaaaacattaagaatcttttttcccccagccactaacacagcaatagatctacatataaattgttagttcccttcttttgtattaatatctctatactcttgttcactattttccaaaggcattgagaagttaatcagaagtttatgaaaaaggagactttctaatcacagaaggttggataacactgagttaaacagctttataagtcacaggcctttttagaacccttagttcattgtggatcctcaattataacataatgtaatgtaataatataatatatgggaggacgcttcccaacagtcatcccttttcctggtaacaatatcttgattgtcctttagggaacctattcctcattcttagtccctgagttctggtgaatctgtcccccattcctggctttagaaatgttcatatgacaagtgattcattggtaagtgttaaaaaccaattctaaaaaaaaagaagaaaatccttgatttgtagcatttgacattttccatggtgtaaatacttttaccatggccaactttaagctaccaaggtgaaatcactaaacatggagttgggaagagaggcacatcatcagctcctgggaacctgcagcgcacagtgtcagagatgacccagtctaagtgaatcagaccatttatccctctgggcctaggactcaagccagaccagctccttaggtccaattcctttgatttttttaaagaactgttgtggaagaggcaccatctttcactgcgttcgttgaaaggaaggaattggaaccaattctggtgatctactttccatgtggtctgtttggaaagagcctggctgagaatgcagaccctcagagaagtgactagcagagctgagagatggagacagaccaaattctgggatcactgttggagtccttggatcttgtccagcctgaacctctggacattgctgttacatgagccaataaatccccttcgtttctctgtctctcattctgtttctcttcatctccctcttatccattatttgtttattaatttttcttttattaaagctgtttggtttttatttcattgaaggaatatgaccattctgtatttatttatttatttatttatttatttatttatttatttatttattttgaagactgagtctcactctgttgcccaggctggagtgcagtggcatgatctggctcactggaacctccgcctcttgggttcaagcaattctcctacctcagcctcccaaatagctgggactacaggggcatgccaccatgcccagctaatttttgtatttttagtagagccgaggttttgccatgttggccaggctggtctcgaactcctgaccacaggtgatctgcccacctcaacctcccaaagtgctgggattataggcatgagccaccacctggcccaaccattctgtatttcaaagagcctgccatgaggttaatattcccccagagcaacttaggaactgccattctagctcattctctccctacacctcacagagactgggtactatgagtaactgtcttctaaacatctgatctgactgctttgttgtaaaggctgttcagattcaacctattcaaaattgaactgatattttctgctgaaaacacacttctcctatgactctcattttcattaacttatgtacaaattatgtgcctgaccagggatataacagtgaagatgataaagttcttgccttcatggagctctcattctagagagagaaagagaccatgcataaacacataggtaaataatgtaccaatggcaacttgaaataagtgctttggaaaaaaattaagtgggtttaaacggatagagaatgacaggggtttctatgctaaatggagtagttggaggaggccttcttgagaaggaatttttgagcagagagggctaaatgaaatgagacaagggcctatgggagtttctgggggaccaacaggcacatggttggcatgttccagaactgcaaggaggtcagtgtggctggagtccagaagcatggggaggttggagaggtatctggggggccaattaggtgggatgttgtaggcaggataaaggactcttgaatttcttctgcacatgatggcaagatttggagcatgaatccctctgccacatgtgtgaggagtagattataggggtcaagaagagacactgcactgaggggctgagtagggagtgaccatgctggctaagaccaccctcctagctatgctggttgggcatcatctatgactttttcttctccttcatttgctacattcgtgcatacatgcccaactgggggttttgtttttataatgcaccttacagccatcagaagcaggttgagcgtcccaggatacagactctaggacagagattagtgtgggagaggtttattgggagtgctcttgagacagtagtttgtcaaagagaaggaaagaaagcacaactgggcagagaaagaagttcaactacaatgtggtgagttctgaggctgagatggcccttcagagctgtcctgagctgtggtgagaggtaggggcctttatatccccagtgatgatcagtcattgatgccaccatcccaggaagaggtcatgaccttggccgaaggccctcttttggcagcattcccagtgacttggataatctgatcattattactgaaggggaggtctgggcaccatatcgcaacaccctggtaccacatcacccatttttacacttgttactgaaactgccttgatttaatttctcattcttcttgctcagattatagcccaccattctatctcgagttatactccaaagtaaaagtcaaattagtctttattgcctacacaatgacatttagactcagcacagcattgagactcttcaagagccagatgtcatcccctactgcagggttcactggactgtggcctgttaggaaccctgctcagcaggaggtgagaagcaggaggctgctcagcaggaggtgagaagcaggcaagcgagcattaccacctgagctccacctcctgtcagatcagcagcagcattagattatcatagcagtgtgaaccctattatgaactgcacatgtaagggatctaggttgcatactccttatgagaatctaatgcccgatgtgatctgaggtggaacagtttcatcctgaaaccatcatctccacaaccccagtccgtggagacattttctcccatggaaactggtccctggtgccagaaagtttggggaccgctgccctactgtgtgtcttacaatctgggcagacaagcctaattggcacaccctaaaatcgcactgttgcttgaatctgaaatgttgtctttccactctatctattaaaatcctattcttcaaggctatatcaaattctacctcctctttccgaagaatctttattctaatattcatttcattctgcctagagtatgttgcttatttgttagctgggtaagtgcagtaatgaggccctcatcattttattcccccttagttctttacagcatttaatatggtggactcccgataagtgttagttgacttagtttgtttcagccttcgtcaatagctagatgatatcctgagtggcagtatagcagaggggttaccagcagagattctggacccatactatcttgattcctcaccatttaataggtccataacagttagataattaagcatgctataccttaacttgcccgtctgtaaaatgaagataataatcccacccagttcttagggctatggttaggattaaatgaatttgtctaagtagagcatttagaacagtggctgctatttaataagtacatgtaagtgttggcttataatggtacctaaagattattaggggacctgcccaagtcaccagttcccaaggtagcccatgttcatcaagattgtcccagaagagagtgttgttcttgctgagattctgtggagaggacttcatacagttcttctgtaggaaaatataatagagttcttgttttcctcttatgagcatacctttaatgagtgaggattttcttgcaaaacatgttggaattctgtgctttcctgaggctttttcggtctggacttagactgggttttagaatgaacattatgcactttcccggtgttgcaagaaaaaaaaagtacaaagcatcatatttataagtgaatagattcatggacactttagaacttagagttcacctatcgcaggagacaagaaaacaaagagattcagtgacttgcctaattaaaggacaaagttacttaataacgttagccaatttgtgtctgaagatgccattttttcagcatgtataattcagacaaaagtagatctaacttgctaaatctccacagaacaaaaaaagaactcttgtttaattttaaggctattgtgttatttaaaatttatcctagatttggcacaatacttactcttcttataattaattaccttttctcatgagcaaaaatagttaccataattattcattcgtttgtgtattcattcattactcaaaagccatttgtgagcctcttttatgtacgaagcactgaactaaaaattggaaactttgaaaatgaataagccctagtgttctgtgactggctcacatctgtagaatctgtgtgtctcctgagtagtccaaatttaagcaacttcaaaatgtgggtgtaggctgcaacttgatcttcatcagccaaaggttaaatattgttagccacaacgtcagtgatcagattcagagccaaggtgctgctatatacaaccagttatcattaagtgagcatctttcactagaaacgaacaaatagtatgcactagtcggctgggcacagtggctcatgcctgtaagcccagcactttgggaggctgaggcgggcggatcacttgaagtcaggagttcgagaccagcctggccaatatggtgaaaccctgtctctactaaaaatacaaaaacaattagttgggggtcgtggtgggtgtctgtagtcccagctacttaagaggctggggcaggagagtcacctgaatccgggaagcagaggttgcagtgagccaagattgtgccactgcattccagctcaaaaaaaaaaaaaaaaaaaaaagcactagcctccttctcctcctctcctttgctcctactgattgagctgtacaaaagccagaagaaaaaagatgacatgacattaccaattttgtagcacaatgtcttgttatcataatgcaatattaatgcaggcattatgtttctatgagatgttaagcataaagtgaaaaaatatcccatggtcaatgaatttggaaacttctggttaaacaaccttaaaaatgtgtcttttagtgtgcttccctttctgaacttttagcatgctaatatgcatcatgaacctctaagagaggcctaaaacatttgacctaagtcaaactaacttgcctgtggaatcttttgtttgcagggagggcattacccatgagtactttcaaaccgaaggtcaattttgtaagtttctgtggttcatcatccattaggtattgcttttttctaataaataggattgtttttactatagcttaagcccactttatctttgaatattattatggagaaaaacgattcaaaatcgtctgtataagaatcttgtctttacttgtatattagtctgttctcacattactataaagaaatacctgagactgggtaatttataaagaaaagaggcttaattggctcacaattctgcaggctatacaggaagcatagcagcttctgcttttggggtgaccttaggaagcttccaaacatgcagaaggcaaagaaggagcaggtgtcttacatggcaggagcaggaacaagatatatagagtgaggggaaggtgctacacactttttaaacaaccagatcttgcaagaactcactcactgtcatgagaacagcaccaaggggagagtgttaaatcattcatgagaaacctactcccatgattcattcatatcccaccaggccccactgcaacattagggattataattcaacatgaggtttgggtgggggcacagatccaaactattgatttgaaaatccttataaagcacccctcaacatttgtgctaccacctgtttatccagagcttatgacagacatctccagtctatcctagtgctccttctgtgcgggcctgaaggggggtcagaatatctttccaacgctatgcttcaggcagtcatttccaatccatgaaatgtaacctgctggattgaaatgaatttgccatggttgttaacaatagctaccccttaatagcacacctactacatgccaagcactttgtgcagccttttacttagaatctgttatttcatctccattttaactaccatcatagtcatctaagtcaccatcatctctcacccaaactgttgtgatcacatcctaaccaatcatactccttccctacacactacgaaacagttcaaactgtgtgcatggtctatataacctgcaagatgtggccgctgcaactttccccatctttgtttctgtcactctcctgtgttctaaccattgatccacagctggattgcaggtttggaaattcagccttattagttcactagaagggagcaaaaccctagagagtcaagtcacactaatcagctcacaagagcttaatgtgtaatgcacaataccaatttactaatttaaaatgagaaatgcaacaattaaaccaaccagatatttgtgttgcttgtctgtgacttctttctggaagctagaagtagccattaggagcttttgagctggaatcagactgcctgagtgcaaatcttgactctctgcttactaactaggtgatctcaggccagtgggtcagtgtgcctttcgatgtctacttcaccatcagtaaagcaggggataataatgaatcctacctgtctgcgttgttgtggttaggagtgaatgagaaaacatacctgttacatattaccatattacttagaacagaagttgatgcatagtaagcattcaacaaatattagcgactgttcctagaatgaaaatctactgaaagaactaacttaatatcagagcaaatgaaattaaataattttaaacagaatttcttttgccagcgtgttgaccttgtaagttactgtttatgcattcatcccattcagtagttattgacacccaaataatttcagacatgatcagatgcacttggtagtccctcatcgcataaatataaatgaatgactggatgaatactgaaatgtaaatttacaaatcagcatatatttttgcactttcctgattttgtcaccactcccaccctatttcccagtcctctttttgccttcagtttaaaaggcttaaaaagcaatcaaggggctgggtgcggtggctcacacctgtaatctcagcattttgggagcctgaggggtatagatcacttgaggctgaggcagaccagcctggccaacatggtgaaaccccgtctctactaaaaatacaaaaattagtcgagcatggtggcatatgcctgtagtcccaaattacttgggaggctgaggcaggagaattgcttgaacctgggaggcagaggttgcagtgagccgagatggcaccactgctttccagcctgggcaacagagtgagactccatctcaaaaaaacacaacaaaacaaaaaaaaagcaatcaaggtaagccaaccacttaaaagcccggcctgccactgcatctggtcttcactctcccctctgcttactcctgtcagccacactcactgtctcttttccttacacatgccaggctccttccctctatagacttccctcatgctatttcatctgcctgaaatttgtcaccccaattcttggcctggctcatgtctacttgcctcagacactcctcccagaccccccggactggttagattccgtgattgcaattttcataattgtcattacatggccattgtttaccatgggtattccttcccagtaaaatcaatgaggacaaggacacttttttgtttcctgctggatctccagtcttcagcacatgggtaggtagtcaatcaatcattgttgaatgaatgaatttaatcttctcaacaattttctgtaagggaaagtcaaggctttgagctgtcaagtgacacacctcagttacacagtcaaactgagagcaagttcgaactcaggtctttcaacgaaagccctttactacccagcactgctgccacttggtttctgcaagttacctaactatctacacacaccatcattttccttagcttagactatactctactttgcatgctgacggtcacagtcttttcctaagctctggacttttgctttcattcttgagcctatccaaaccttccctgtaatatctatacacattgttttacctctatagctagaatatgttatatttcatcctatcaagacatcttttgttcccctgcaaccctgcaattccacacctacgtatatactcaacaggaacttgtgcatgttttcaccaaaaggcatgcactgaaattgtcacagcatactattcataataactccaaactggaaactatccacatgcccatccaagcagaacagatcaactgttttgtattcatatgtcatattatataacagcaaaaataaatggtctaaacttaacaacacagatgaatctcacaaatgtgatgttggaggaaataagtcaagaacattctatttgattccacttagaaaaagttcaaaaactggcaaaactaatttacagtattaaaagtcaggaatggcagctactcttggaagagtagtgattggaaggggatggtgggggccccagggtactgataatgttcttagtgtttagcttataaaaattcaccaatatatacatttatgatatatgcacttatatttatgtatattatactttaagaggttttataaaacaactttgtatctgtttgtttctgattacttcaatttacggagacaagtttgcaatctgatgccgttgtctgatgtgctggttacccaccgtttgcccagagagagcttcctatacatgaaaagagaccactctgaattgtttaaagtctaaattgtgacaattgtgaagaacacagggctgcctgccatagactgtcagaaatccactaatggctgtgctgagtccatgggcagctgtggtttggggcacaaattaacaaacacacattacacagtccgctgatccagaaaatgtgctggactggtttcccacctctcatatctcttctccatcctctgtaggacccagaggccccccacctataggctcatccctgctctgggttctgggaccaatcttgtccttagggggaaatttaaagagacagatttgggtaactgaggtgacccgggctcaagtcggtttagctcagatacttggaatggtaggcctggaaaggaaccttgtgaagattgctctttctaggatttattcctgtgtcactggttttgcattttgtttgagaaagagatacagaggaaggtgatgggggaagggcatcataatgctgtggaaagaccatggctttgaaatcagactgctgggcccacatactaatgccgtggtttaatcagccacgtggcctggttatattcctccctgagcctctgtttcctcatctctatggtagggataaaagaaccaaatttaaagttgtgaacctcaaaaaccaccttgctggtctaagtcactatcatctcttgtctgttattgcaataatctgctaacagtcctctctgcttcctgcttgctccactgccatctgtggtcaacatcatatccagaacaatcctgtttaaaaatgtaacttggatgattcttccttttgcttaaaacctgatcatgcctttcaatttcttacaggtaagagccagagttcctatgattatctaaaacaggcataaccttgctcaaccttggcactcttgacatccagagccagataatttttggttaaagagggttgtcctgtgcattataggcctagctttccatgacagacttgccagcattttcttggttccacttgactataatgcgagccagcgctgggactcatagaaacgtgacaccatccgataagcaaacaactacaaatgccaagagtgaaagaaggcttagaggcttggctggttgtcatttttaatgtgttaacgtgacattagacagtttctttggcaggtatcacaatagtgtcagcagggaatcatctggttacagtagttagttgcctgtgataaaggatcaagtaatcaagtacgtattatttctatctcagattttcttcatgcctgttatagggagggattcggggcaatattcagacacattcaaagcacagagttgtgaaaattagtcaagcaacactgaaactaaatttttaagtagaaatggatcggacacaatcctaaagtgctcacataagcaaaaccattgattgaaccatactgcatttgtctgagataaaattggaaatcatttatcaagctgtcagtggaatcgatttgaactgacactgatgacacaaacagatattgaaggttataagaatttcttgaaaagcttaagacattcaaagacaccagttaaaaagatttttatgatttggtttctaaacatctggtcatggtattcagccaactcattctcctccctctcctttcttctcatcctgacttaatgtctgagtatgaagctaacaatggaggaggatgtagtgctgattgatggaaagaagcagatatttgaagctacgttttgagtatctagatctaattgtaaatggagccctgatttcagctgactgacacctctcgctctgcctacccacctactccttcctttctgattattccctacccagctctcaggacttccatttaccacacctgggcaaatctccccggtgccagtcatctgcctagactgccccttcaccttttcccacactgtccagatagtgccttgcctgcctagtcttcctcccacaagaacctgcacaccctcctcttcctgcccactgactgatagcatccccacctcccagacaccttcccagagtgcttctctccagttttgacatgtcctgccctgtcaaccaagaacttcatcctctcaaaaaccatggacgttttagctctgtaaccaatgtttgttttgcttaacacagtttgaattaagtttctgtcacttgcaactgaaatagcccttgatcttcattggtaacagaacttaatctttttaaagcagattggttttggttttatttttttgaaagagctaagggtcacttagaatcaggctttttgaacaacataggcatttaagcatgaaagtatcatttgtgcataaaatattttgcactaaaatgtaatgaatataaactcaaatgtgataaaactgatttcatacatgcttccaggaattccaaggaggaccctccatggtgccttcttaaattgaaatgacatttatttaaatgcatgttatcacatgactgttaatcaaacagtggctttagagtggcatttttccaaggtgtggttaacagacaagctgcattggtaacatctagtttaaaattcagattcctaggacccatccaaggcccattaaatcagaatctctgagaattgagcctgagaatattcttttattttcctttttcttttcttttctttttctttttcttttttttttttttttgagacagagttttgctcttgttgcccaggctggagtgcaatggtgtgatctcggctcaccgcaacgtctgcctcccggtttcaagtgattcccctgcctcagcctcctgagtagctggtattacaggcatggaccaccacacccagctaattttgtatttttagtagagacggggtttctccatgttggtcaggctggtctcgaactcccaacttcaggtgacccgcctgccttggcctcccgaagtgctcagattataggcatgagacaccacgcccaaccaagactactcatttttgataaaattccaggtaactactagacactatttcttttttttttagacagtctcactctgtcgcccaggctgtagtgtgtagtgtagtggtgcgatcctggctcactgcaaactctgcctcccgggttcaagtgattctcatgtctcagcctcctgagtagctgagattacaggtgtccaccaccacacccagctaactttttaaaaatatttttagtagagacagggtttcaccatgttggataggctggtctcaaactcctgacctctgatgatctgcctgcctcagcctcccaaagtgctgggattacaggcgtgagccaccacgcgcagcctagacaccatttctttaagacacgtttcatatatattttttttagttcaccttcaagtgtactgtcctaacctaaagaataattccaagaacacttcctcatttagacaatcaatacagaatgagtacacctgtgaaaagtggtaaaggttcagataatttagaaatacttagaagtagaaggcattagtcaccttaggctcagttggctgtggtaacaaatgatgcaaaatattaatggcttacaatttcaaagacttatgttttatgcatttacatttccattctaggactctccagaactctaagatgtcagaacaaactttgggacatagctggtcttgtagcaaaggatacaaagaatagatgaactacacctggctcttcgagtgtctgatagaagaaacacaccttacccacagccatgttacattggccaaaacaggtcacgtggccacacttggggccagtgaagtagagaaggataatatttctacagaaaagggataccacagggaggagcagccaacattttgaacagaaatataatctgctatataggacatttcataaagtaggtcaaatatttttggaaaaaaaaaagaggggagtctatgtatggtcagttaagtttaggaactcctacataatacccatctctagagctatgcaatgtaaaccagcacaccgaaggctctcagaagtcctgcaatagaaaaataaaatcaagattgtttaaccccaagtttccaagctttgtttccatggaacattttccaaacaccatctcaacatacctcaataatttgaggtatactcaccaagaaagtcaattatgttatagacaaaatactgcaacactttcttctactataaagcattcatttgagctattcctaatagaatgttgcataataaactctgtgtagctttgagctattcgtgtgtttttaaaaatgtgatattctactaggtcatccaaaaacctggggaattctatgcaaatatcttaatattcaacagttacaggctgttgaaatttaatagtgttaatggagaacacataagaggtgactctaataagctagctcttccaggtagaagagtgttcccaaaaggattttaattttaaatccttctcattactatgtttggaattaggcaattcctgtaaattgaagcaatgcacttttttccccatttatgggaatctgtcattttagaagttcataaataagttctgcagttataaattagtataaaagtacttaattctatgagagtcatcatcagggaagctcattttctactttttctccacctccacccaaatgcatccttgtacctcctccactgggatactcataaggtgcaatgtgatttatgctgctgtggaagtggaggttcttgtttctcaaagtcactatggctggagtgtgccacaaacagaggtggctgtggttgcctcctaattcctccagttttaagtcattgtggtgatcatcattttgaaaacccatcctctcttctctccctgccaccttcctttcccttatcactgcctcccagtcaaagtttctctggctcttcctcctagatctactccttaaatcatggggttcctccaaattcttcccttgacactcttttcaagtcactttctacatctgccagggtgaattaatctgctacctggccttctgccccacctagatctgtctccaccccacattgctcctagcttcggtcccgtattctaactgccagtaggtcatctccacctaacctcacatctgcctcaaaattaatgtatcccaagcaaaactcgtcattttcctttcctaaacctgctctttttttccctcgttccaattcattgcttcagcaccaattgagcctcttcagtaaagaatgaggcattatctgtggctcctccatctctgtcacccctaagcttcacctcatgcccaccttcagcctctgcagccccataaatatgagactcgagatgttcttctctatctccgtgtgcttcagatgcttattaccactttctaggcttctgagagtgggatatggattctggcacccagactgcttgggatggaactctaatgctacaatgtctttggagtgacttagccaagttattcaacctctctgtgcctcagtttcctcatctataaaaaaaggatcattacaatgtctaccccagggggtggttgtattactttggtaaataggtgcaaaatgcctcacacatggtatgtgcacaataaatagtggtggttaggattataaaaacgctttagctgatttccctggtactagcatcattcccctcctattagaatcatctttctaagaaaaaaaaaaacttatcaggtcactccttagcttctgctggctttctactatttaaagactaaaactcaactttcctagcaggacgtttaagaccctttgaaaatctgttcccaggctacctttctggagtatttctggctgtctttctctaaacgcggagtctacactctcagccaatctgaacttctcaccattccgcaaccactccatgccctttcatagtcctgtgccttttcagtgactatttttgtgttaatcagctttcctaaggtacgctgctgtaaccagcatcccatgtcttggaggttttcaacagcaaggtctatttcttgcttgtatattacacattggctgcaggttggcctcagctttattccaagagtcttcttttttctgggactgaagtgaaatgagcaggtcctttctggaaatggttttctcacatgtcagagggagaagagtaatactggaatgtcacgatgaattttgctcataagtgacacaaatcacttctgttcacattttattgagctgagcaagtcacatggccaaaattgaccttaaatggggcagggaaatataaacctgtcacagggagatggaacaagtaattggaaacaataatgtgatctcgcacagtatcctatatttgaaatgccaccacacattcctccttttccccattcttcaaaccttcaaagctgcattatcacttcctttgtgaagcgtttcttttgccaccaggtagagttagctcacttctccgcattcttgcaagcctcacttctaagaatgtgcttattacactggacaaatgaccacttctttttttttccttttttttttttctttttttagagatggtgtcctctctgttgcccaggctgaagtgcagtctcatgatcatagatcactgcagcctcgaactcctgggctcaagtgatccctgctcctcagcctcccaagtagcacgtgacaccatgcctggctacagccttttcttgatttctctgtctccagttccaagcatctcagaacatactgacagaatgaataaatcaggcagtttgttgcttggcaatttattagacaggattgggaactaatatgcagaggtaggtgaccaagtaaatccttcaatcaggcagaaaggagttggaaggatcagtgagactcagtttggttttttctccatgttcactaaatacttacatcgttttcttattttgccctcagtctgttgctatgcaagaacaaataccttagagatatgctatttatgcaaacagccttgggcatttatatatatataatattcaaattaaaataaattatgcacatatagtgtttgttaaaactttgcttcacatcaagtgatctattaaaaagacaaggccagcaaaattatctccatgaaccaccagtaagcttcatctttagtaacctttttggacaatactaaatcaaattgctaggttttcagtgttacctccaaagtactgcagattcatcccctgccagcatttcactggcactgtcttagtttcggttctcatcactgttaatctgcacttttatcacaatgcttacttggtttccttctgcccagggaattccctgctgccacttcctcagcacccttcaatcaagaagctattcatcaggcattgccttccttctgaaacctctctgacgccctatcttcaccgtcctccaacagagttaaatccggtctctgtgtaactttttatcattgtgtttgatcgcattgcattgtaattatttgtttatttgtctgtttcctcttgatggaataagagtcgtttgagaacaggcactgcagtatgctaattcctccctatactcagagcagagtgccttgcacatacgtaacgtgttcaattgatgcttgcttgttacgtagagctgctgttgaactgaaggccaaaattatgagttataaatttcatgatcagtaatatggtacaacttataacacttttttgatcttgcattctaacatatgctaatattttcatgatacatggagaatggagtgtttctagtattaatcatatgctttatgttaagtaatgtagattttcactttcatatataagcaccatgcaaggctttttggaaacgaaccaattctcatgagaacttattagtgtattaagaaaacactgacaccaaaagttcaggctaaaaaagcaaaaataaataaatgagactacaacaaactataaagcttctgcactgcaaaggaaacagtcaacaaaaagaaaaggcaacctacagactgggaaaaagtacttgcaaaacacgtatctgataaggggttaatacccaaaatttataaagaacatttataactcaatagcagaaaaataaataacctgatttaaaaaggggtaaagaagctaaacagacatttctccagagaagacataaaatgatcaacaggtatatgaaaagggtactcaacatcactaaacaccattgatatggtttgactgtgtccccacccaaatctcatcttgaattgtgactcccataattcctatgtgttgtgggagggatccagtgggagataattgaatcatggggttggtttcccccatattgttctcatggtagtgaataagtctcatgacatctgatggctttataaggggtttcccttttccattggctctcattctgtcttgcctgctgccatgtaagatgtaacttttgcctttcaccatgtgaggcctccccagccatgtggaactgtgagtccattaaatctctctcttttttttttaattaattacccagtctcgggtatgtctttatcagcagcatgaaaatggattaatacaaccatggagatgcaaattaaagccactgtgagacaccatctcatactcattagataccatttcacacccttttgataataggactattattgaaaagtcaagaaataacaaatattggtgagatggtagagaaaagagaatgcttgtacaatgttggtgggaatttagattgatacagccatgagggaaaacagtatggaggctcctaaagaaatttaaaaatggaactaccatatgacccagcaatccctcttctgggtatacacacaaagatgaaatcacccactcataaagatacctgcactctcatgttcattgtggtactgttccatagccaagacatggaaacaacctaagtgtcaacaaatgaatggataaagaaaatgtggtatatatgcatatacacacatacacaaacacacacactggaatattatttagccttaaaaaagaaagagatcctaatgcttgccacaacataaatggacctgtacactatgctccgtgagtaagccagacacagaaaaaaaaaatagtgcaagacctaacttatatgtggaatcttaaaacagaaaatcaaatagacaaggagaatgaaacagtggttatgggtcagtggggagaaaatagggagatgtaggtcaaaggataaaaagtagcagataagtaggatgaacacacctagagatctcatgtaaaaaatggggactataggtagtaaaattgtattgcattagggatttttgttaaataagtagagttcagcagcttttgtcacacacacacacaaaagtgactatgtgagaggatagatgcgtgaatttgcttcattatagcaaccgttttactatctattaatacatgcatctcatcacatcatgttgtaagcctcaaatatacacagtaaaatttactttttaaaaaagaagaaaatgctttccaaagaaatattcttcataggatattgtatgatggctaaagaaaaattagatgatgccataagtgtttttattatctttgtaatagaatacaaaagctaaagttttacttaaatcaaaaattaaagaaataaagagaatttaagttgcgtgctttagaaaaacagtacaacatactgacttaaccagctcttctaaaagaaaagaagtcaagtacaaattacatccatttaattagctcaaagatgaaaatttcagttttagtaactgtaatacatgttatgtaagagaccatgaggaacagatcaaaaggggttgtaattaaagtgaatcttcccagaaccttgggttacatcaggaacctggccagaacaagcaaggctactgacttttgccagggtcatgtttggaggtcgctttaacatagctctttgcttaaaaaacataatttgggcataaaagggctcccaacgttcaatgatctccatgtgcttcccattagggttagaagaagaaatgctgtggtagtttcttcaaataaaatggaatgggattttcagaactctttccaacttggcaaaacaggatgtgtgtcaacctggacatcaggaaggcccagatatttctaaaatagagggacacacagtcattcagagtcacatatgaaccattgtaaatggtaacctagttgctcattttttttttcatggaggaaagcatctaggtcagctcatatggctatctactttactctaaataacataataattttaaaaaatataagtcaatggcaaaatattgtccgtaagttcccttgctagctaggctattatagacttggaagttgccagaaatgacctgtcacatcttctcttcttcatccactccccaccaagagagcatgattgatgacccagagcagtcaatccccttctgtttcccatctgcaactgggctaataggaagcaactaagccgagtgtagcatcacttttggttacttatccggtatccgcttccccttttccccacttccccagccactgagacataagtagatatttgcctggggttctggtaaaagcttttggtttccttttttcttttctttctttttgttgagacagagtttcactcttgtcacccgggtgtcaatgaaaagcccccattttaaaacatcggctctgacccatgacatagcaacattatggcctcgttcctttaactcacagtttcttccagtgctaagaattatgacaaactgtcctacctatgttaaattttcagcaaagtttataacttaagagacctggtcagttggaaataaaagaagtctcacacttataatgtttaaataaaagaagatacaagtctgttacaccaagctgtacataacatggtcctcattatgaaaatcctacctcagaattctaactgtagttagagtgttcacctttcattattcatgtagaagcctcagatgtaagactttcatgtggattccataattatcttttgcaaattttgtttttatgtgatactcactgtagtcattttccaagtgctaacatgtagattcctataggcaccactcatatttctgtttaaaaaacaacagaaacgttcaaactggtaacatctgattgatagactgggttagggatgcttacacctggagtgtagccagacccgaggcccttgcaaacacacaattatactagatccatcacatcaaagccattttctgtgttgcttccaattttaggtctggcacattgtttcaactcgttctgctttaaaactctcaaatagttttcagatgaatgggtgcaaaatggcagcttgcatatcttcctttaactctcctttttggaaaagtgtccaccaaagaatttagaaatgaaagaaatccatcaattaagcatttgtgttattaataatagccaccattgactgagacactgtgtgccaagaattgtgctgatctacattacccttcaccagtctataaggtagactgatgttggtctctcgatattaaatccttcactcatccatttggagagttttatgaacagccacaggactacaccctgggaatacagtactgaaaaaagtagacctcctgccccttacccctccccaccccagccctctacaaacacacaaacatcccatggagtctaatggggaacagacatcccaatgcagtgagtgtcaagaaagagggaaactgaggagcatataccaggggtcctaacctagacagggatgggaagaaaaacctcacggataaaaaagatgtttaagcctggacattaaaagttattccggcaaacagggaggcgttactggtgctggaggtgaaaatcactccaggcagatgagacaagatgctgttggacaagacggcccaggagcaagaaagagtcaggtagcacttccgaaggactgaaaaaaaaaaaaaggccactattgcttgagctaacagaactagcaagagaagactggtgagataggcagggaccagatgctgtgggccacatttggaactttatcctaaaggcagtgaaaagctattaaagatggtggtggtggtggttgttactgttttaaaagagtgtacgggatgggggacaaatagggagaagaatgatcagatttaaacccagaatctgagaaataacattgcccaaagtcactttaaagctggagtttgaacccagcgggctagattcccaccttttgctcctaacccatgaatctctattgccttctagttttaccagcttcattctagtcggggcaacttatcaaaatccatcaaaagacccttcaaaagcacatgtatctagtgcttaccatgtgcctgggcctacattaggtgtagggattcaaaggccctggcctggagatatgccctgccttctgttccttctcagttgctactgtagaatttggaatctgtatttctgactctatccattaatacatatcacaaggcctgttttatttttgacctagagcaacattatatcaaagcataagttagctgcaattggaggttgtgagggaaaccattctctcattagcaaaatccccaatattcaatataatgccaacattaacatgtgacatggatacccagttgcagatgagtagactgaggttctgaaggttaagccactagcccaaggtcacacaggtggaaagttctaggttgagaggcctagaactgtcctctgggaaaccaaactctcagggctacacagtcaagcaggttttctctgatcaggtgctcagtctgaaaaggaaggaaggggagaagaaagggcttgaggaagaattttaatatgaaggacactgtatgcaggatgatgagactgtctaatcattccccgtggctttaaatacttttattgacctcattgttaaaaatcctcacagaagtcagtattacagagaaaagaaattaattttcaattttaactaaacctcatttttcttccctacttgttttttaagttaaatgttacatgtggttggagttgctagtaagttatgcaattttgctcagacaaataagtaaagaataaaatatttataaaaatcagaaggtatatttgcttaggtctttgaatgtctttttcaaaaggccttaaatccctatggattaatcaagcacatctcagatattgtccttacaatgctcaggaaagaaatgacccctaataggataaaaggcacattacgatctgaacttgagaatttgcctggaaatttttctttagaactggaattactctagaaagtgtatgaaacactctgagcttttcattatttccccaaatcatctatctataggttagcaatgcatttatacattttacccataaaaataaagtagatccaattatgcatatgtttattggtatttattgtacttctactttgaagagctctatgttatttcttttttttttttttttgagatggagtctcactctgttgccgaggctgaagtgcagtggcgcgatcttggctcactgctagcttggcctcctgggttcatgccattctcctgcctcagcctcccaactagctgggactacaggctcctgccaccacgcccagctaatttttattttttttttgtatttttagtagagatggtgtttcactgtgttagccaggatgaagagctctatgttactgatctcattttaaaaatcatattctttgggatactgcctcctttaagtgtagggctaactcctttccccatgtttttttacaacttagctactgatcatgtttaaacaagaaatagtaatgcttatgttatactttagaggactatgaatatcaaagtgaatgttccttaactattaaaaaaataaaatggatgaaagtaattttgcttattaaaaataattcaactttacaacagctagttctcaagtgaaattgaatcccaaattaatcccaagtgattcttgaaaatgctataaaattcaaatctagtaccatcaaatttaaaaaaatgggaaaagggttaaggataagatttgataaccttattccattaaataatagtatatggaaagtacggaaatgggattttagaattattaaaatttaattcccaaattagagttgcaatagcaaagggtcagaaggcagagaagaaaatgtgtgtgtgtgtgtgtgtgtgtgtgtgtgtgtcctccctccttctttgtcctcgagcagaaagtagctccaccacttgtaaagggagtccctagagaaaggaaaagcccttagctacatttcccagatttggaaacctggaaatgctagaattgtgagggcagggtgtggcaaaatttctacttttcactgtttagaaactctcttatctaattggaaccaaaccatctatgtagttaactcatttaattcttacaaacccgggacacggatcccattttgattattcctaccaaaccaatggtttttctaagacataatttaccaagtaatttatcagaggtgacttagtaaatgcaggacctagagttagcctcaagtcttttctattattttctcttcctctcctgaatacagaaatataggctttgatcatttacattctctgaacaaattatttccacatgagaacagattacatcctttgactatgatgagtagagacagatcctctggggaggctgatttgcaagctgggtacttgaaaatccccagggaggactggtcaaaaagccagaagaccatacaagcatggggggaagggactgggaagtaagagggagatgaaagtagggaggtgggaaaatacttggtaacttttccttggaccctagagacccgtgtaccattgtaaacatcatttgggtatctcctttgacactgcctctgttgtctgtgcctggcataacatggaaaggtaaagcagtggtcctgtgatattttaggtaactaaggaccacctatgactgataatcaagaggcaaatactgtttcaatgatgaccgtgaataacaattagaagaagagctattatttatgaagagcttattgcatgtccaccgccaccatcatcatcatcaaaattcattagcatgtattgagtcctcactatgtaccagacactgttccaagctctttgcaagtattatcccactaaatttgtacaactattcagtcaagtagataccattattatctcccctttatagaaagcaggaactaagacaaaggcagaaacattacttgtccaagcacacagcattcaaacccggggatctgacaccagtgactgcaaatgacttacacatttcattcaaaagattgttgttgactcccttttatatgccaggttctatgaggaggtggtgaagcaatgttgagaaaaagttgacataaatcctgtccttatggaatgtacagtcagctgagggacagtagtcaaatgatgatataaataaatgtagaactgtaatggtgccaaggattctgaaggaagggcttgcagcactgtaatagtatctgtccagaagacctgccctagtttcatttaatcttcacaacaaccctatccctattttgtacattggaactgcagaagcaaggtttagggagagacaggaaagccctctaggcacttgcctaagggcaatctagtcaaaccttcccaagttatgaatcaattttttcactctgggccatgtcacattttagttgccattagcaaatcatttcgcttagaagcctaagtggtaattatgtgcacattaagggatccagaatactgattttactttagtacaactcacacttttttgtatgcaaagatttcccactgctcatataacagacaccaggcatttaactgactgctcacatgggcatgcaggcaagaggtattcagctgaggactccacactaatgttttggacttaacgttatgctttaacttttcatctgttttgtagaatgtagaatttggcttaatgactatgtttatttctgttcaaagcactggaaataaaaggtttgtgcagatgtttgaaggacaccatatagactattcacaaacttttgtggtcagtttagccaccatggtcaggcccagtgactcactctaaactgagttttgttgtttcttaaaatattgttttgctcttgtcctcaggaaagttggtgtattcgtcacaaacattgctaggtgggagaagggggtgacaggaggtgggataatgtgaaacagtctgtgtgacgaaagtttgtttcaactttcctagttattcctaagactgtgtttgacctaaagagcattttgatctagaagacaccttaaattggagggtctagtgaaaacctgcatgctgtgaagcagagagctgagtctctgagagattcagtgatatcaccaatgccctggactggttggtggcacagacatgcttaccactaactccagcctcccaagaaccacaatccatagttccttaactccactccatgctgactcttggacttaaactcttaatttcttttggtgttattatttcttcccttctctccttttcatgccttaaaggtggtgccacaatcatctgaactgacatatattagcccactaactatggccttgtagtttttgccaaataaagcattagttatgtaactctactctgttttctgggagtatagagttttaaacagaaaattttaaagaaattggaaatttctttaagaaaaaaaaagaggaaagaattaaaaggtatagacaagcaacatcaactagcttcataaattaaagaaattttaagtacattatgtaaggctgggcacagtggctcacgcctgtaatcctagcactttgggagcctgaggtgggcagatcagctgaggccaggagtttgagaccagcctggccaacatgacaaaaccctgtctctactaaaaacaaaaaattagccaggtgtggtggcacatgcctgtaatctcagctactcaggaggctgaggcacaagaaatgcttgaacctgggaggtggagattgcagcgagctgagattgcgccactgcgctccagcctgggcgacagagcgagactccgtctcaaaaaaaaaaaaaaaaaaagttacgtgagacggcaccatatgtgcacattttttctatttttttagaaaaaactaatagtttaattaaattaaactaatacttttaaaactatttttagtttgtatggatatataatggttgtacatatatttgcaaatttaatggtaataaatgtgacggacatagtagctgactatttcagcaatggggtcaggaacaattgtatctttcctgattagccaggaaagaatcaaggagaaggagcagctgggcgtggtggctcacgcctgtaatcccagcactttgggagaccgaggcggatagatcacgaggccaggagttcaagaccagcctgaccaacatggtcaaaccctgtctctactaaaattacaaaaattagccaggcatggtggtgcacgcctgtaatcccagctactcaggaggctgaggcgggagaatcccttgaacccaggaggcggaggttgcggtgagccgaggtcgagccactgcactccagcctgggtgacagagctagactctgtctcaaaaccaaaaaacaaaacaaaacaaaacaaacaaacaaaaaacataaaaaaggcaggggaggggaagatgtccagtatgaaactgggggggatgttaatgaattctgttagaatggggaatctggcataggtaaaaacttaaacctatgctgtctaatacaattgttgcttgccacatggagttaagtttaaattattcaaatgaaatgtaacttaaaaattcagttctgtcacatgagacacatttcaagtgctcaatagccacatgcagctagtggctattatattggaccacacaggtgtagaatattctcatcattgcagaaaatgctttcagacagggctgacatagaagatgcatcagagaagaggagggggatagacgggtgggtagatgagaggggcacataaggtaattgcaacagaatgaatgtttatgtctcccccaaattcatatgttaaaatcctaacccttaatgtgatggcattagcaggtggggccttggggaagtgattagattgtgagggtagaggcctcatgagtgagattagtgcccttataaaagggaccccagacagctcccttgtcccttttgctatgtgaagacatgataagaaaacggtcctctaagaacgaggaagtgggtgctcaccaggctctgattctgcctggtgccttgatctgggaattaccagcctacagatctgtgagaaataaatgatttttgtttaagctacccagactatcgtatttttgttacagcagcctaaacagaaaaaaatagaaacgtttaccaggaaaagtatatgctagatggataaggggaaacaagagagacaggacacacggacgtgatccagggaaaggtcttgaattgggttagagcttggattcaaggcattggctggctgcgataaaacctttgcgcatgtttttttaaatggtgttcctctgggcagaagcatcctgtggttttggctagtagacagttctttgtgcaaagaaaaaagtgtactttcctcaaaacgatggagatggttaaaagatcagtggttgtcagggcctggagaaggcagggaagaaaagaaggatgaacagatggagcacagcagagttttagcaatagcaatgaagctattgtaagatactataacggtgcatatatgtcatcacacgtttgtcaaaacccatagaatgcacaacacgaagagtatacatagtatacatagtaatgtataccatgaactttggttcatactaatctattaatattgattcatcaattgcaacaaatgtaccacactaacataagatgttactaacaggggagactgggagtggggtggacagggtgggcaggggtatatgaagctctctgtactttgtgctctggctttttataaacctaaaactgctctaagaaataaggtctagtaatgaaaaataaaaagggaagctatttaactatttctcataaaatattttcaggcactctaaaagtcttcatgttcacatacacaatgacatgacaataaaacacactaatctggttttagctgataatctaatgtagttatatgtgattctatcaatatctgacatggaaaaaaagcgaaacaatgtaccttcctctaggtttccacagagcagcttcaggcattcatcttggtgagcagtgtgcaagctggattttcctaaccacttgctctcttcctcaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctgggtaagtacaggtcacaggaaaccacacaagaaatacacttttgtaggacaaagaggtaaggtcagagccctgagagaccctcacaactggtattaaagcagagtgaaaagaaatctaaaggggggacaggtctaaggggacatgggacacaaagccaggaaggaaggaagcaaaccccagcagtgctgtacctggagggcgatgaatgagtcgcagaggctccctttctgagctgggattaggagttgataatggtcttgcaagtgcagttctgcagagcgaaagggcccggtgccttgcagcagagacacgttctgggagagagggttaggatttgagtaagttcacactaggaggctatatatacatgtgtggcattgcccagggactggagggaaagaggagaaggaaatgcatcacaacaatgactggaatgcatcagcagtgcaaaacaaaactcttgggaaaaccaaattgtgtcttggattgtggttcaaggaactagtaatgggataaaaagcttttgcctccaggccagcagcatgagtccaacccaggttaggagtcagcagtgtgtttcagatgtcagtgtgaaaggaatccatggggccaatctaaccttctagtattagagtaatcctgaaaaccacaataggtctttttttttttttttttttttttgaaacagagtctcgctctgtctcccaagctggagtgcagcggctcgatctcggctcactgcaagctccgcctcccgggttcctgccattctcctgcctcagcctcccgagtagctgggactacaaggcgcccgccaccgcgcccggctaatttttttgcattttttcagtagagacggggtttcaccgtgttagccaggatggtctcgatctcctgacctcgtgatccacctgcctcggcctcccaaagtgctgggatgacaggcgtgagccaccgcgcccggcccacaataggtaatcttagcagcctgcttcatgagatgactgggaagggaagatgaattgtgatactggctcattcttagccacggagggagcctctttagaataagactggagcaatatggacaatttgtaccactcctttatatataggccaatgctcctcgaagcttgattcatggaccagttgcacccaaatcaccctgggctgcttattagcaatgcaaactttcctgggtccactctagaccaagtgaatctgcatcgttaggtatgggatctgggaatctgcattttagcttcttatgtgattcttgtgtacaccgaagtttgaagattattggggcagatcagaggttctcaaactttagcaagcatgagaatcacatcacttaaagggcttgtgagcttacaggtgcctgggccccacctccagagtttccaattcactatctgggatggggcttgagaagttacatttctaaaacatttccaggtcatgctgctggactagagaccacactttgagaaccattgctgtaaatagagctctttacctggctcggacagtgtaaaatcgcccttaccattcatccacataattcagctagcttctaccatcctgtcatatagatgactaacacccatgacctctttttcaccttgttagataacttccagttttaaattgacaatatgaaaaacgatcacacctggtcaaccctaatcttgtatattgttctggttccaaatgtttatattattatcaacactgtcctttcctcatttttggcggtgacctgttcaactttgtgttaccttgggcttcaaaatgcaaaatcagctcctttctttgcttgccataagaaatggcatgcaagaaaaaaaaaaaatgcttccaaaatagaggaacctgaaaatattctgaaattcagaaggtgttattttggggagcctttctgggacaggatgtccccatcatcagctagaggaagcccagcttctgataaacaaagttgtgccttgcacagatcaaagggagccatttattgaaggaagggatggaagtatttgatgaggcccttctgcagactccctgtaaacaggataaaccctatcaatgaaagcttatactcagccaggccacagtccccaggaacaatggagcaacaagaacattgggtggtgaggaaagagccttggtccagacaagattgttctgccaagagaatggccgtaaacaggattagttgtaatgagattatgaacttaggacctggaggcctgagctggagagttcagtgttacataaagaaaagacacagaagtagctcgtggggtgagaggatgccaaaaggacaaggacttttccttcctagcatccctctagcccaggggtgccatctctctggggaggaaaaattagtcactgtaattgcacatattgcttgtgggagtagacaaactagggactaaagcaccaaagtagtgggcctcaattaggggatgctggcaatgtctgaagacatttttggttgtcacaactgggtgaggtagtgctactagcatccaaaggcagaggccagggatgctgctcagtatcctacaatgcacaggacagccttgcacaactaagaaatatccagccccaaatgcagaggttgagaacccctgtgctggagtgacggagagggaatccagctaggatgctggtagatgaccagctggagacggagcgtggcagtggtggggagggaaggggcaagtatttcatgggcttagtctagagggacttcacattagcagtcctcagaaggtgaaagttggttgttgagtgggggtgcatggagcaagaaagttatttattttatgcataaagcacatacagtgcataaggacatagacagcatttctggggtattcaagtttcatggggattggtggggtgcttgggaaaataatgtctaaaaaggctccttaggaggtgataataagaaaaaaaaaggttgagaaacactgattagactctagaaattcacccactttccccagctgcatccaggattcacatggtgggatctttctaagaaacaaatctatggcagtgactccatggctatgactggtttcttattgccttcaggataaaatagaaatatccttgtattttaaggcacctctttttttttttttttttttttatttatttatttattttttttttttttctttttagagggagtctcgctgtgtcgcccaggctggagtacaatggtgcaatctcggtgctctgcaacctccccctcccgagttgaagcatttctcccacctcagcctccaaagtagctggaattacaggcatgcaccaccatgcctggctaatttttgtatttttgtagagatgacgtttcaccatgttggtcaggctggtcttaaactcctgaccttaggtgatccgcctgcctcggcctcccaaaaggcacactttcaatctggctcctgccacattctacctaacattcctagtgtcagccatagtgaatcactgatagctgttcccaacccactgagctttttctctgcaggcctgcatcacccgctcctgccccttcccctgacacccctcaagtggctaactgctactccttctcagctcctccacgaggtctgccctaacttcctcaacactgggctgcttaccccttttctgcacttcccctagcataggatgtatcttactcctattgtagcattgttcccactttgctataataatttacttccttgtccgtaaggaactcttaggcaggcttctatgcctagcacaatgcctggtgcatactgaaacctcaataaatattggttaaaaccataagataatttgcactcattatctcctttcatccacttaacctcctttgagatagctatgattatccttatcttgtagaaaagtgcatggatttctcagttgaggaatgggtataaccttcttctatgccctcttctgggtcctaaaccttatctagacctatggccagaaaagagaatgagcaggcttcccccaggagctgttaccagtagaaagagcataacttagaaatgagtcacagaaaaaacaaagagtaaagacagaaagtgagtcagggataagggttttataaatacaagtgtttcccattctgacatctataggataaaccaaaggcagcacctagctctccaggaaacagtttgaaacccattgccttaaagtcctagagctaagatatgcattttcaatagagtgaccccaaactggactttctggcaccattactgaaagggtcactggctcagttacagaatccacagggtatgataatagttgagatggaagtcctcagggtgcagtttgaagcatagaccttgagaacctggagatcagcgggaaggtcaggacccaaggcacagttcaggagtcatcattagtacatagggcctatgttacaggtggtctttgaagctgtgagagtgaatgaaattagagagggataaaagtgtggagtggaaacacggctgagtatggaaagtgccaaataatctcccactgtcttgcattttcagttacttttttaatctatagcttatcttctcaattagtttacagactccttggtgttggggacagctttaggtactttaaaaaattttaaagatgcttaagaatttaattaacaaattaattaaaccttttccctccatcattaaacttctggaaatagctgtaaaccaaaaataaaattctaaaccttctgaccatgtgaatggcctcatcctctcagtaagggcattccaaagttaacctgaaaaactagttcaggccatgatgggaagggagggtcagacatgcctcattgtaccttcctcccttttagaaatactgatagaacagactctttaagtctgataagaaacatttttacaatctattctctctgaagcttgctacctgggggcttcatctgtatgataaaaccttggtctccacaatcccttatcttaacccagacattcctaagtctttagacaataacttaactctttcaaccaattgccaatcagaaaatcttctaatctacctatgacctggaaaccccctgcttccagttgtcccacctttccagactgaaccagtgtacatcttacatgtgtttgattgatgtttcatgcttccctaaaatgtatgaaaccaagctgtaccccaagcaccttggacacatattctcaggatcttctgagggctgtatcttgggccattggtcactcatatttggctcagaataaatctcttcaaatactctacagagtttgactctttgtcaccacagctttccttttgtctttacttcctttagttttaactatttgggttctgccagcatcacaggactgaaatgtctctttggcaagttgcctataacttctgcattgccaaatctactggcctgttctcaagtcaccttccgcaatctctgtagcaatcagcactactagttcctctcattcactgaacagttgccatccctgtctttcatatcactgtgttctcttggttctttctcagacttctttgctgaatattactttcagcctcccttcctggctccttttcctctcttggtcccctaaaagaagattattgttcaaatttctccttgtccctctcctctattttttcaggttctaccttgacagtctcatccatggtctcagctgtggcttctaggatgatgactcaagccctgatgtctttcctgatcattttgggcctgattctctggaactgcgggaggaagctgaatgctggtccaccttttaacaatgtggccagcagccctgggttgatactggaagcaaacattagtctggtaaactacacaaggacaaaggtagaacaggacacacaggggtaacactgaccttagaggggtgttatggactgaatatttgtgttctgctcaaaattcgtatgttgaaacatatgtctatctcatgatttcgctcccctctaatgtaatggtagtagaaagtggggtctttggaaggtatttaggattagacgaggttacaagatggagccttcatgcatgggattagtgtccttaaagagagtcctgagagagcttgcttcctctttctgccacgtgaggacacagggagaatactgctgtctatgaaccagaaaataagccctctctagacaccttatctgctgacaccttgatcttggccttcccagcctctagaactgtgagaaataaaatgtctgttgcttaagccacccagtctgtggtgtctggttatagcagcctgagctgactacaacaagggacagtcagccaggacacaaacttgaaggactggagcaaagatgggaagagaaagagatgccaggtgcaggtgggtctgctgtcagttcaggatttctctcctggaccctgagttcccgccatggcatagctcttacctggatttgtgtactacttatagggtcacgaacagtacatctgtactgatttccagaccacatttccatgaggccttgccagatccttccactgggacctcctggctccttcctccaagctcacttgacttttgttctccagggttctgcacttggctcacatctttgcgtttcctttttcactttgctgggtgatctcatccactcccatggcttgagatactatttttaggctggcaactcccaaatatgtatctctagcctaaactccagacctgtaagtctacctataaattaaataagaacctaaaaatcaatatacccccaactgaagctattctcttctccccaagctgactctgttctgtctcctgtgttctcactgctggataataacaccaatgtccatccaagctagaaaccaccgcatcatccttgactcatcaacctttctccgtgtgtgagtcaatttgcctcttaatcatctgtcaatttattcacacttttccttctccattgccaatttcttggcggctctttatcatttttcacctggatattccagtcgtttatcaaccagtcacttgtgtccagtttcacaacctcccaatcagtcctccaatgccattatacaattttctttagagtaggaagctgatgatgttactccatagttcagtgacttctcattgtctcctaccagataaaatctagacacaattcttgacatatactcctctttctctatgtaggcttatttacagacattttcctagtagtacttcatacctttggtacaaatagtgttagtctccataattgaccatgctgtttcacaattccacacccttgcacatgtgtgctcactacctggaatgccccttccctttattctggtggattaagtcgttcaagccccagtccctccatcatcttctctttgaggccttctcttttcttttttttttctccatctcttcttcttttacatccattgtatatacctgttttccagcattagcgggctaaattctaattccttgtttaggtttttatcttgccgtctaaattctgagttcttcaaggacaggggccttatctcatgatttcactcccctctgcagctagcacaatgcttctaaaactgtattccttggattgctagtcttattgttacaggtagttagacaggcaagagtggagcaggaaaaggatcttcttcccccacccactaggaatgtcagatgatggttcgacaattatcacactgactctctcaggaagagacaagctcctgctgatccacagctgttaacattacagtgttaattgcatgcagacacctgggaaaaacaacttcctgggaatacgcattaaaagacaaaatggagtatgaccttccaggggcacaccactggagaagggaagagagcctcagacgtgcatgcttacaacttcctaaacatactgcgcacgcttaattcccaagggtaaggcaggcactgtgcacgcgggccgcccacccgaaggaaagaatcaccctaagggaaaagggtacaagatggcagcctataaagtcccagggtcaaggttaaacactgcacttgttctccaaggcacccactggatctcttccacgtgttctttcctttctttcctcttctaaagcatttttaataaacttccacttctactttgaaacttgccttggtctcttttcttgccttatgcccctcagttgaattctttcttctgaagaggcaagaattgaggttgctgtagacctgtacggatttgccgctggtaactgagataccttccaccagtcacactatgagttattttaaaaggtattcttgaaatgagaatctgtggtcaaataaattttggaaaaactgcatattcacattacctgtgagctcagagaagtctttcagcagaaacctgtttaatctggtttaactctgtcccttccaaacccaaggtcagggaaagacccttaagcagatccttacaacgtatgtgcaagaagcaaaggtagagatgcgcccagacaaagggtgatgtgggaaaacagagaaggggctgccccagggtccaggggttctggaagcatttttggaaaaaaatgatctccatcactcacaagaagataatggccaatttaaccctcagaaagaaaacttcctagttttctaatgtctccagggactaaacttcaggattgaatgtaactatccaagggttttattacccaggaaggtcaagtcttcaggatgttttcttctcttattcattcctgtggtcagactcaactttgaactggtctactccacagatgaaccacatccttcaactcacttaacagcatctattatcctattgttgcttatatttttctggttatgtcctaatgatctccagccacaataccggagggcagccactggtcatttacgctgtcatctcatggactctaagaggcccaagcacatagtgagactcaacaaatgtttattaaatgcagtgaacacgagcataatctaattcttcctatttgccttgaggtggcagagatgcaaatgtggtgacccagagcctgaacttgggcacttggagctcatgtggagcattttctgcagtggctgaggctgagctgggcagaacttttcttcgctgcctctatctagaagaaaggaaattaactagtcctactgaactcccagacctgtggagaggagaaaggggcaaggcagcagaaaggggcaaggcagcgtctctgacttggatatccagcacattcccccagagacagccatttgttttgtaaaccaaagggtgtctgagacaagtctcaatcaatttagaaagcttattttgccaaggctgggagtggtggatcacacctgtaatcccaacattttggaaagctgagttgggcggatcacctgaggtcaggagtttgagaccagcctggccaacatagtgaaaccccatctctactaaaaatacaaaaattagctggtggtgggcacctgtaatctcagctacccgggaggctgaagcaggagaattccttgaacctgggaggcggaggttgcagtgagccgagattgcgccgttgcactccagcctgggcgacagggcaagactctgtctcaaaaaaaaaaacaaaacaaaaaacaagtttattttgctaagatgaaggacaccccatggcacagccccaggaggtgctgacaacatgtgcgtaaggtggtcggtgtacagcttgcttttatacattttagggagacaggagacatcactcaatacatgtaagatttacattgctttgatctggaagggcaagacaactcaaagggagaggggcagcttccaggtcataggtaaatttaagcgtattctgactggtgattggttgaaagagttactctcagtattattatcagtagaaaggaatgtctgggttatgataaggggttgtggagaccaaggttttatcatgcagatgaagccttcaagtaacaggcctccgagagaatagactataaaggtttcttgtcagacttcaggtttgtgttgatactaatactggaggggtacaatgaggcacgtctggcctccactttacatcatggcctgaacttgtctttcagcttaaattttagagggccctgaggggtgagttttatttttggtttgcagttttacggacactgggctatatttcccattttgcatagaggcaggcaccacatagagactaagagcaagcactgtgttcaatgtacggactggaatccttgcttcactacttgctcgctttgtgattctaggcaaatttcttgacc

SEQ ID NO: 1130 - DNA, 42262 bp, Homo sapiens
taacaaaagatatgcaagaacctgacagagcaaattataaaatttcattgtacaacataaagaagacctaaataaatggagaaatacactatggatcatggattggaaactcaatattataaggatgtcatttctcccctgaattaacatatagattcaatgcaatcccaatcaaattctatgagttttgggttcagggagttttgttttgtctttggtagattctaaaatttacgtggaaattcaaagggctaagagcagtcaagatttttttttaaaggtggaaggagttactctaccaaatgccaagactgattatacctaagattatttataatttgtaaaaaaaatactgtataaccagaccaatggaacaaaacagagatcccagaaaaagacccacaaataaggatatatcatctacaacagataatttcaatgtacattttaaaaataactaaaagaattggattgttacacaagataaatgcttgacatgatagataccccatttaccctgatgtgattcttacacattgatgcctgtatcaaaatatcttatgtaccccataaatacatatgcatactatgtacccacaaatattaaaattaatttttttaatctacaatagaggcggcagggcagattaatggggaaaggacaatccatttagaaaaaaattaaaatttcacaccatacacatatcaagacaaggtggaatataaacctaaataaaaagggggtaactacaaattcatgataatatggatgaatatcttaatatctcagggtaataaaatatttcttacgacccataaaccaataaccattaaaaaagactggtaagttaaactgcattaaaactgagaacatacagctttcataagattccattaaaactatgaaaaacaagccacagggtgggaaaaggtatttgctacacatataatcaataaacaactaatacacagactgtatgtaaagtactcacacaaaatcaattcctaaaaaacccaaagggaaaaaacaatggaggagggggataacagcaaaatatttaaataagcaatttacataagaagaaattcaaatcatcaataaacatacaaaacagagctcaacctcattagtaataaaatgaaaattaaaacttacaatgagatggcattgtgcatccaccagattgtggtaaaaatgaaaaagttggccatacaaagcaatggcattgatgtaaagcaacattgttgtgagactgtaaatttctacaaccactttagaaaacagtttgacactacctaataaacattgctgtagcaataaagattgccatctatgagtgaactcccattcacaattgcttcaaagagaataaaatacttaggaatccaacttacaagggatgtgaaggacctcttcaaggagaactacaaaccactgctcaacgaaataaaagaggacacaaacaaatggaagaatattccatgctcatggataggaagaatcaatatcgtgaaaatggccatactgcccaaggtaatttatagattcaatgccatccccatcaagctaccaatgactttcttcagagaattggaaaaaactactttaaagttcatgtggaaccaaaaaagggcccacattgccaagtcaatcctaagccaaaagaacaaagctggaggcatcatgctacctgacttcaaactgtactacaaggctacagtaaccaaaacagcatggtactggtaccaaaacagaaatatagaccaatggaacagaacagagccctcagaaataataccactcatctacaaccatctgatctttgacaaacctgacaaaaacaagaaatggggaaaggattccctatttaataaatggtgtcgggaaacctggctagccatatgtagaaagctgaaactggatcccttccttacaccttatacaaaactgaattcaagatggattaaagacttacatgttaaacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagacactaccatcagagtgaacaggcaacctacaaaacgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagacaccatctcacaccagttagaatggcgatcattaaaaagtcaggaaacaacaggtgctggagaggatgtggagaaataggaacacttttacagtgttggtgggactgtaaactaattcaaccattgtggaagacagtgtggcgattcctcaaggatatagaattagaaataccatttgacccagccatcccattactgggtatatacccaaaggattataaatcattctgctataaagacacatgcacacatatgtttactgcggcactattcacaatagcaaagacttggaaccaacccaaatgtccatcaatgatagactggatgaagaaaatgtggcacatatacaccatggaatactatgcagccataaaaaaggatgagttcatgtcctttgtagggacatggatgaagctggaaaccatcattctcagcaaactatcacaaggacagaaaaccaaacaccacatgttctcactcataggtgggaattgaacaatgagaacatttggacactggaaggggaacatcacacaccagggcctgtcgtggggtggggggaggggggagggatagcattaggagatatacctactgtaaatgacgagttaatgggtgcagcacaccaacatggcgcatgtatacatatgtaacaaacctgcacgttatgcacatgtaccgtagaacttaaagtataataaaaaataaaaaaaataaaataaaaatacaaaaaaaaaaagattgccatctatgacccagaaattgcaagggtggctataccctagagaaactcatgcatatgtatacctgaaaatttgtataggagtgttcatggaaacgtttgtaatagtaaaaaactggaaacaatccaaatgttcacctactatagaatggattgattgtggtatatttatggaatgaaatactacaaagcaatgaaaatgaatgaacttcaactactcagaatatcatgaattaatctcacaaattataattttgtgcaaagaagcaagacagcaaagcatacacacaatacgattccacccgaatgacttcaaaaagagaagaaaacattttgcttagtaatgcattcacagatggtaacattaaagaaaggaaggaaatggttatcccaaaagtcagaatggtggactggagtagtcttaagaaggggtaagatttaggaaagaaaaggaagaatgtatctaaaagaaaaaaaaaaaacagcagaacagttacagagatggaaacaagcatagcatttgtggaggtacagtgaaaacaccagactgactggaggacaatatgtaaactagagaacaagtcaacaaaaggaggaccaggtcacagttaaccttaaaatccaagcaagggtttggctttaacactgtaagaagccacttatattcttgaactgcacaatcccatgatgaaagctgtgttttagggagacttaatttgcaacacacttgaattagaggagggagggactagatcagctagtagctttctatggtcacctagaagtgaaataataaaggatgtccaacgcagcttggtggcattcatttaaacactttatgtgtcagatatccatgggatctgtgtgaagcactggaaataaaaagtcaaaaccagacctgccatcaaagagctctgaaaagcagtataaaaacagggaagggggtggagggacataagaaatgtaactttttaaaaaaacagctcatgaaatcagtgatgaagaaaagaaaaaagtcaaagtttcctagccctcaagagccctataattcaagtacacataaggtaagcacaactatatagcccaaggattgatgaggaagagaataagcaggaagtagccatgactataccacatacatgggagaaatgtgacaaggaaaggaatgtttggttggcagctgaaaatgccagaacactcaatagatctttgttttaggatgagaaagacatagtaagtcttatggtttaagggaaaggtccacaaaaagggagtagattgaagatgttagaacagggaaagttgtgggatcaagactctgagagaggtggcaagagagaatttcaaagtacaataaaataggtaagctttaggaacaagagacctttcaggctcaagggaaagatggttaagtcacctattgagagagtagtatgctaaggttaaaatgaaggactaatggtagtcccaaacttttcagtaagatgaggtagagaaacaaaattgttaaataagagaaatgacctaaggtaaacctcatctcaaatggcaagatattaagacataaagatcaactctggaatgttctagtctctctttaacactattttgcagcttaggagcaagaagcaggttagatattcagcattaagaattagtgagatgagtacaacaaaagatcagggaagtatatgtgttccgcaagataaaacaggcagcacggaagtagttggtaatatatggaactatgaattgaacaaagtagattctgtagattgaaagactgggcccatctgcccagagttaataacacatacaagactaaaaacatctgaggtgttaaataagtcgatatccaggaaatcccactcatgtaagattttccctcagaaataaagatctgatggaaacctttcattaaattatgctacttatgcagcaaaaggatacccggttaacaaaagaaggactaagaaagctggcataactttagggatagtagcagtgacactgttaggaaacctggaactaccacagaaaatattctgcagaaagaaaatatagtcaaataaaaagagtaggccaggtagctcatgcctgtaatcccagcactttgggaggccgaggtgggcagatccctttagccccggagttcgagaccagcctgggcaacatggcgaaaacccgtctctacaaaaagtgcaaaaattagccaggcacagtgcccatagtcccagctacttgggaggctgaggtgggagaatcgcttaaacctgggggcagagacttcagtgagccaagactgtaccactgcgctccagcctgggcaacagagcgagaccctatctcaagaaaaaaaaaagcataagatctgaaatcaggctgagcgaggtggcttacgcctgtaatcctagcactttgggaggccaaggcgggtgaatcacctgaggtcaggagttcgagaccagtctggccaacatggtgaaatcccgtcactactaaaaatacaaaaattagctgggcgtggtgacgaggacaggagaatcgcctgaacccggggcagtggggtggaggttgcagtgagccgattgcgccacttcactccagcctgggcgaaagagcaaaactccatcttaaaaaaaaaaaaaaaatctgaaatcagagaactaggatttgagtcccaatttaggcaaatacagttgctgtttttaggcctcaattcctcatctagaaaatgataacaacagtaagtaatatggaaatcataatagcagtggctaacatttttgaatgcttatgttcctgacacagtactactaatgcattattagaactgtattagctcacttacacatgtattaactcatttaatcctcacattaactttattgaggctgttatccccatttttctgtggtatatgcagaatttcaacctgtgcaatctgatcccagatcctatattctttagtacattttctgcctctctgggttatgaagatgagaatgcagtaaaaagtgctttaagtgtacacaaatgttcatcattactgctgagtatcaagcaacaggacaaaataatcccaacaaaatcctagacaatttgtctacagtctacattccataaatccatgggccttatcctcaaaaagcaaaggggacacacatgtacaaagacaactacttgatatggacaagatatacatgctgcttttctatggtgagctgaagtaaacagtataattagtgataataagaataaagagccttcagaaatcaccaaatcacagcctcaaaaaataactgcactaaatgcaaggggctaaaaaataactgcgacagaaacaagatcattataattctttttaaagtataggtttctgaacaatcacaaagctttgaaaagaaataaggtttcaaacagcaacaggcttttcacagagcaacaaatttcatatacgaacactaggaaaaggattatcatttccaacaaaagcctcaaaccacattataaatactgtagtaaaaaacagttgatacttactaggcacttagagcactgttctaagcactttagaggtaacaattcatttaatccccacaacaaccctacgaggttaagtcttaccatcatcctcattttctagatagggaaaacgaggcagaagtgtggtcaagtaacttggccatgtttactcaacgagtggctgtgctggggtgtcaaacccaggaacttcatctccagaatttgtgctatacttcctctaatagaaaagttaaaaagcagaacacgaattgattcagaagtattaagtattattcaatcatatttgataacaaggaagaacctttcattcacaataagcagttaataatgcattactcatagcagttctgtctttggtattccttccaagttaagtctgcacattctcactggacaatctcatcaacccccacccacccccgggctccaaatgcaatctacttgctgataactctcaaatctagatctccagcccaatctctcttctgcaccttcaacctgcaccaaaaaccaaatagatatttctctctgaatgattcatgagcccctcaaaattaacatgtccaaaactgaatcatcatctccatcccacttgcatctcccaatctcaaactcctttttcctcctgtactcccttaccccaaagactgccaccatcatccacgtggttgcccaacttaggatgtcatcccagactcctcagtccgcctcaccttgcatgtccaatcaccaatcactaccatatccacctcctgtctgtccaataagtgcacatttcttcattcacattatcttaattttataacttcttagaaagctgttcttatttgcattttgtgttgttttgcacaactgattctctttttctcttgtggtttgtcctatcccatctggtggcgaactccactaatagacatacaatttcatatccaactctctaaagtgcacttactttatcagcatgatgttttcagagataaacttctggttctaataagagaaattaaaactaggaatacatgtcaagtaataactttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttttttagtagagacggggtttcaccttgttagccaggatggtctcgatctcctgacctcatgatccacccgcctcggcctcccaaagtgctgggattacaggcgtgagccaccgcgcccggccagtaataacattttttaatgacatcatcatcagaagtaagacctaattattttacaaaaaaaaaaaatttcctgtcatcataactccctgggagaaactaattactacaagtgtttgatgacaggtagtataggccctgtactatcctacgcacattacacaaattatgccacttaatgttcacaacaacactatgagctgggtcctattattattctcatttgccagacgaggaaacggaaatttggcccaacaacttggccaaagtcccaagctagaaaataccaatcaggatttgaacccatgtcggggtctgagagtagagcccatgctcttaaacacttgctattttgccccttcaggaaaaaaaaagtgctagaacgctggaaagaaagaaaaaaaaaagcctctgcctcgaaagcagctaggacgacaggtgcaacaccacacctggctaatttttttgcagagatggggtgggggggactcgctatgttgcccaggctggtcttgaactcctggcctcaagcgatcctcctgcctcggcctcccaaactgctgggattacaggcctgagccactgcatccggcccaaaatttttaaagaaatgtcagcaaactaaaaagactcagagccacagaactacaactgccccaaaacaaaaaaaggtaatttaatatgaatgcttcttttcttgggacatcataattcacacaaatatgattttattaaaacaaaaatgtctactgtctcatacataagtatactccacaaagaaattctacaaatattagagtcctctgtcatttaatttttatttggcgggtgggagaaaggtggcaaccaaccaccacaagtaggtgaaaggctttgaaacctccacctcaatcacttgctttacttcaagactgcaatcacttgctttacttcaagactgctaacatataaaaggatgtcagtgtataaagaacactgcctatcatccatcttctcgggtgctctgagaaacacaggcgcacagttaaattcacaggcgaactcagaacaagcttcagcctgcaatccgtcagggattcggcagctgcacaccgaaggtgcagcccgcagctctcaacttttcattctgtccacacgttttcaatcctggacgcacaagtccactttgaacctggcccgagggtgcaaagagggttcctgtcagatttctcaggaagagagagacgcgtgaaggaggggcggcctcccacccgccccgagccgccgcgcgtttctccttttgttggggtggaggagggcggaccccgcaccctctaggggccaagaggggtgggcggagagacgggagggggcgaaacgccgcggcggcccccgacgagcccgggggtgggaacacaaagaatttgggaagcggccgaccgcccttccataaacctccgcagaagtccaggcccgggccgccgaggagcaggaggaggcgggcgcgctggagtccgcggccctctccgctccctgccgaggctcagcggcgggcgcgggctgaaggccggggttcgagggcggcgcgaggcctccgctaccccctcagccaccccgaaccccttccgccccgccgcgagccaggccgcgggatcccggtgccggccccgccacacccacccgcctcctaggccaggcctgggaggactccgcggctctttctcgggcggcggcggcggcgcgccccacgccggatatttacctgctgatcttctgggcgaaggcgcggcgctcggccatggctgctgcggcgacggcgacggcggcggcggctgcggcgggccgggtgcggaccggcgggcgcgtgcctcctcgctcgtgctccctccctcgcggcctccgccagtccgggctccggacctgggaggctggggctggcggccggagccaggaacgagccctgccgtaatgttccttagaggcgcgcaacgagaaaccgctcctcccccagcgcgtcaatcccggcgggaaccccggctgcggaaggcggctgcggccggcgggagccgaggggaagaatggagcgctgaggaagcgaggcgccagccccagccgcttcgctgccgcggagcctgcacgaccgagaggtcgcggagagaagccagagacaggccagcgacctggcgaggcaagaaaataagataaccgaacgcgtagggggagcttggctttcccgaaatggaagggaaggaaatgaaaggtgggctttgccgagggggctgtgctttaaccaaagccctggatgactgggttcatgtttctgcagcaccggtctccgagctttttaaagcacttgggtttctgcttcggcctcatgaatgcagcctaactggagaaacagtggtttttcttatagagaaagagccagaaaataccttgctcctgcagcgataacaatagtaatagttgacttctggtgcttagccagccactggattaaagtttttcaagcacgagcgctttgaagtagatcgttactatcactattttagagggaaggaaattggcttggaaaagctaagtgactggccccaggtcgcacagatggtaaactcttccactgagactcaaacccagagccggttcttttctttgaggacagttgtttccgtattattaaccccttttggatctctctctgtctctcatacatacatatatatatatatatatatatatatatatatatatatatatatatatataaaatccaggtgagctctaacgttcacccccattttgatgttctgttaaataagctctgtgttgaccactgaaactgaccttgtccataatagcctataaaacagagactagcagagatttgttttcatctgttctgttgtaatcccataatgtctagaatatttggctcctaatgcatatctgttgatactgaaattatggtgacactaagaaaaatatcttggtttcttgtagtacctttcctcttaagtattgcaagaacttaaaatgtgtatttatttattgttattattatattctcagtatgtcctggtggaatatgttggatacctgttttcctctcttttaccattggaaaatctgtagcttggagccattaggtcacttgccagagtcacacactgagtcagaggtgaaagcctcaattagtcagatccataacttcctgtctagtgctgtaacttctgtggaagactgtgtatttatataacaatgctcattgcagtaacacactgcttttatttattgatttatttattttagacagaatccccctgtgttgctcaagcatggaatgcatagggcactgcagcctaaaactcctaggctcaagcaatcctcttgcctcagcctctggaggagtagctagtaccacaggctcttgccaaggcgccctccagtaacacactgttttcagatgcttgtttactaaaggaaaagatagtctattcaaagaggacagatatttggcttctacctaagtatagagcccacctaggtgttctaaaaaacacgaaggtgaactagacacagacctgctctcagaatgtttgagtccattgggaaagatgaaccaggtactcacagactgtaagtcaaggctatcactgtacctggcttttaagaccctctgtgataggaacccagacttattttgccactttcttactctgtaaccttaggcaagctacttaacttcatctctaaaaggaggaaaataattatatctacttgaaagggtgttgtgaagatttattgaattgattaatataaagttcttagaacagggcctggttcatggtaagtacgatgtgtgtcagctgttgttattattatcactgttactgtcattattcatcctatacttaagcttgtcctgggtgtttgatagtccctgaattggttgtctgctctcatactcccagccagatgttgcatgcctttatctctgttctccaaacatcttttcactactctcttagagaactggccacattttgctttgaatagttctttgtatacatgactcactagttgccaaagtgtctgaaaggactttgcatgtactctgcagcttactggaaacatttagagcaggaagaggacaagcaggatcacgctgtaagcagggtaattcagagtctggggaacactctaagcaggaagggtgaccccctacctctggggaagagctggcagtcacagaccaagtcatgttggctggtatccctgccccacagggtttcaatgtcaggaaaagatatggaacgcagcaatgggagtgacagtggaattgcttcagctgactagcatccatgctccctataccaccccctacacacacacacacacacacacacacacacacacacacacaggtgtcaatccactatacttctggggagctcactccaccaccctcagtttcaagggtcttttgacctgggcctcaccaagcaaagcagcacactcctctggcttctgtaactgatttagggataggctcatgaatcaaaccaagacaatcgggcccaaccagaattagaaattgcatttggtataccagggcactccatctaaagaaggcctacctgagaatgaagccaagcacagcagagaggagagcaaaaatattgaaaaagacaagttccttagaatatagcatgacttgagccttggactttgcagttacatgagctaaaaatgtgctggaatttttttgggggtgtggctggtttttcattaggtttgctttcattagcagttcaaagtcttacctgatacaggacttcattcagttaactaacattcattaagtactatactagaccctggaaatatagtggtaaatagcgcagtatttctgtcctcaaagagtttagggtctggtagaagagaaaagtaagtaaatagtaagttacatgctgagacaggaaaaattaaggaagctattggagtgcatataaattcttgatagcaccagttctcaaatatgaggtgttaaaaactggatggaatttaaccctgtccttagccctgttatataacctaggagaaaggctggctgcaactccgggagcatgagtagcccaattcagaattcagggcccaagctccccactgatggaaagatacaaagaaactacttgccagaagccaggaccaatttggcagagtctactcaaaacagtgagttttaggtaagaaagcctcagaacagttttcattagacataccagtgtactaagtccctcaagcagaaaacttagggatatgacagaaaaaaaaaagtaaagagaaaagaaggtgggaaaattatgagttttgcattctaccctttattgaacttgggtctacccgctttaatgtagcaccaaggaggattgtggaggggtctggtcaagggtctaaggctacagtacaaagaaatagagttttcgggtcatgatggattaagttctggctttgcaggcagaatgtgttctcttttgggatttgggggagcatagggaatggttcctttttttcaggcatgggcttttttttttttttgagacggactctcactctgtagctccagctggagtgcagtggtgcaatcttggctcactgcaagctccgcctcccgggttcacaccagtctcctgcctcagcctcccgagtagctgggactacaggtgcccgccacaatgcccggctaatttttttttatttttagtagcgatggggtttcactgtgtttgccaagatgatctcgatctcctgacctcgtgatccaccagcctcggcctcccaaagtgctgggattacaggcatgagccactgcgcccggccaggcatgggtttttatgaaacaccgctggtttcatacaataagatcaacatggagcttccttctttggaagcctctagcaaggccaaatgaatgtggcccagagaaagggagaactgaggcatgatatgtgggtttacctcaatcccaaactaaagcctaggagttggacactaaatctaagctacagatgcttttgcctgactttgtcctatgtgcttcacttcctgtcaatatctagcaagtgtaatttttgcagggggaaattaaggggtcctcaacctggccatacttaacaactaatagcacccacatttactttgttgtaatactcaccacactattgaagtattgtctgttaatctttgcaccccatcgaacttgatctcttgttcaccattgtatttccagtatctaatacactgcctggtccattataataacttagtaaatgtttttgagtgaataaatgccatgaactaaagtatttttagatcctgcctgtattcatccgttttcatactgctataaagaactgcccaagactaagtaatttgtaaaggaaaggggtttaattgactaacagttcagcatggctggggaggcctcaggaaacttacaaccatggtggaaggtgaagggggagcaaggcagcttcttcacaaagcagcaggacggagaagtgccaagcaaagggggaagagtccttataaaaccatcagatctcctgagaactcactcactatcacaaaaacagtatgggggaaaccgtccccatgattcaattacctccacctggtctcttctttgacacgtggggattatggggattacaattcaagatgagatttgggtggggacacaaagcctaaccatatcactgccttaatttatatttccccaaaaatagagcttgaggcttggatgcaggtagtttattaggaagtgatgctaagaagctggaatgaggaagtggagagagtagaacagagaagggaaagccagtaaatagtgttgttgaggtgttaccactgtgggcaatttaggctcaatcccgcctgcaacctgcgtaaagtgtggagtgcacctcagaattgtctctttgaggctcagtatttacctgatgccatctagatctcttggctgaaggcttactattggaatattaactgcccgcacacttaatactacaaaaagctaagagacatggtgtgtgtttctggtggccagctatcagtgcccctgagaattgttcaccacagctacacctaaaatcggaaaggagccatggggtgaagtacagggtaccaacagtgtctattacagatcccctgaaagtaatgcagagactacaatagggatcttgccagaatagaacgtatttgcacctcatggttctgctgctttacagaattgggaaagaccaaaaggccagaccacctgagtcaaaatggcccacaatgcaagctcagtgcctactttaaaaataggtccataatgtttttcctcaatggactattatatcagtagaaaaaaacagtttttcccatactctaacaacatgcttctgacaccagatatgtgggatttttttccccatacatcaagcaagcaatcgattctgcagcagacaccagttgagtctcctccaattccgttctggagttctggaatctacctgaagttcagttctgacactgtctacctggagttagcgtcagatcccacaggttgagggcttggtcccacaagactgccccccacatccagtgccaattgcaagccacaggttgttctaccagtgctttgactgactgtaagttggggttcccacaacccctttccttgagtttgattaatatactagagcagaacacaggggaatattaatatttaccagtttattataaaagatattacaaaggataagtagaaaagatgcatagggcaaggcatgtgggaaggagcgcagagcttccatgccttctctaggtgcaccaccctccagaaacctctacatgttcagctctctgggttttggtagaggcctcattacagaggcatgatcaactaaatcactggccactgatgatcaacttaattttcagcccctctccccttcctggaggttaggtggtagggctaaaaagtcctgtattaatccgttttcatgctgttgataaagacatacttgagactgggcaatttacagaattaagaggtttaatggacttacagttctacctggctggggaggccttacaatcacggcagaaggcaaggaggagcaagtcacgtcttacatggatggcagcaggcaaagagagagcctgtgcaaagaaactcccatttttaaaactatcagatcttctgagacctattcacaatcacaacaacagcacgggaaagacccgcccccgtgactcagtcatctcccaccaggttcctcccacaacacatgggaattatgggagctacaagatgagaattgggcagggacacagagccaaacggtatcagtcctaaacctctaatcgtcttttaccagcccccatcctgaagctacacagaagctgccagccaccagtcattttattagcatacaaaaaaattattcctttggaaatcacaaggattttatgagttttatgccaggaaatggaatgaagaccaagtatagattttacagtatccagctatatttcaaggtagtcatatttgatgaagtaaaattcttttaaaagaatttcagctaagaaatgcagactcagatgaaataattaagctaaacctgtataatccaataccgtagccacaagccacatgtggccacttaaattcattaaataaaactaaaaattgagttttcagttttattaggcatattttaagtattcagtaggccacaggtggctaagggctgccatactggacagtatacagacagaacatttccattatcatatgaagatctgttggacagcactgatccaaagatcattgctgctaaaccattagataagagccttatggggaactttaaatggttggatcaggctgataagaccagaacccactgatgaatcttaacatcaaacacacacacacccagagttaaccagtcaaacacaccagaggcactatgtgcctcatcacatgatataaagaagggagtgtaagatgatacatctatggaagatgtataggatgtatacagcatcacctatgaaacattcctggcagatatttaaagctaatgcttgttctgtttatagaaaatataggagatgaaagaacatgtcaaacaatatgcttgggttaaaattagcaaaattcaaaatacgggaaattttataggacataatgaccaagttcctttaacaaataaatttcaaggaataaaaaaatattagaagtagagtaagcatataagcaacaagaggtaaattggacataatcaaaatgtaaagtttttgtgcttcaaggacaccatcaaattgaaaagaccacccacagaatgggagaaaaatttttacaaattgtttatctaataagaaacttacatcaagaatatatataaagaactcttataagtcaataataaaaagacaacccagttttaaacttggcaaacaattggaatagacatttctctgaagaagatatgcatatgcagatggccagcacacatataaaaagatgatcaacatcagtatcgatcagggagatgcaaattaaaaccacagtgagatgccacctcacagccactagactgactagaatcataaggacagatattaataagagttgatgagggtgtggagaaattggagttctcatatacaactggtgggaatgtaatatggtgcagtcactttggaaaacattctatcaactccttaaaaggttaaacataagttactatatgacctaggaattccactcctagaaatatacccaagagaaatgaagatagatagatagatagatagatagatagatagatagatagatagatagagaaacttgtacaccaatattcataaaagcataattcataatagccaaaaagtagaaacaaccctaatgtccatcagctgatgaaaggataaataaaatgtgtatccattcaatgggattgatgtgatttggctatgtcctcacccaaaatctcatcttgaactctaatccccacatgtccaggtggaggaaatcagatcatggtggtttctcccatgctgttcttgtgatagtctcacaagagctgatggttttataaccatctggcatttcccctgcttgcactcattctctcctgctgccctgtgaagagtgccttccgccacgattgtaagtttcctgaggcttacagctatgtggaactgtgagtaaattaaacttcttttctttataaattacccagtctcaggtatttcttcatagtagcatgagaatgaactaatacaaggatattattccagaaataaaaagaaataaaatactggtacatgctgaaatatggatggactttgaaaacattatgctgattgacgtaatccagtatttattttgggagaaaatgatataaggtatgacatttgctttaaaaataacccaacatgggtttctgttgatgggtgttgaagctgggtaagagaatatggggtttcattacatcgttttttataagttgaaaaaaggccctcaaatgagtattatgtcagaagagagaagacaacttactgattagagaagaaagggttgaaagcttagctcagagaatgaatcaatcatgaagccagtctaaaaggtctaagcagccagaggttagagtaatcacacaagtagaggaactgtctggccaaaggccgtcttggaaccaatgtctatagtgccctattgtgcaccattctcattttatttcactgagctgagaactgagtgagacctgctggacattactgattatggatctgggcagagatgagcccagtgttctttaggaacagtagggcagatctgggacaagcaggtctcacacagagaaaggacagaaacatcaaagttcaaaagagttgcagtcatggaaaggttctgtcaggtgggagactgtacatgtttgtaggttatgggggaggactagaggagtgagaaaaagtgaaaatattgagagatacttttgataatcttgaaaagaaagaggtatctttcacctgcttgggagggaagaaaaggttggaaaaccacacagcattttagaggtggaaataagggaagttgagggagcttaattcagcatttcattttctcactaaatgtaatgatgtaaggctagtatattagttttttgccactgcctgaccaaaagtgatggtcccctttgttgtataatgtaaactatcaagcaatcggctatctcatatccataaggcctgcccacatgaaacgggagagcctatacaggacatgtatgccagggacaggaatcttggtagaactgcctactacagccaggtaaggatgagaatcttgaatgtatgatcccacattgctggaaatggttcactccatgaactaggagataaggccttggatagggaactagggaccatattgaaaacttaccaagaaatacggagaaccaaatggggaaggtgctgaaagtcataatccctcttgaaacagagggagcaggggactgaagatgagaaaaagtggggttttagttctggctctgccacaatcttactataaagttttgagcaaatcacaaactttctgggcctctctttcttcagctataaaataaaggtgataaaattagaggattgctaaggtaaataacatttctctgttaccattatcgtatggtacttgtacaagtatagaaaaagaattgtaggatattctttttccaaatactttaaagatttgcattatttgtttggggactacttaggcatagccttgcttaaaggtagggaaaaggtagatgattaccacttaagaatgctgccaagccgggcacagtggcttacacctgtaatcccagcactttggaaggccgaggcaggcggatcacctgaggtcaggagttagagaccagcctgaccagcatggagaaaccctgtctctactaaaaatacaaaattagctgggtgtggtggcccatccctgtaatcccagctacttgggaagctgaggcagcagaatcgctggaacccaggaggcagaggttgcagtgagccgagatggcgccattgcactccagcctgggcaacaagagcgaaactgtctcaaaaaaaaaaaaaaaagaatgctgccaagccaataatcatgtggttctgaaatagaatgtcattttataccttagctctggtatttgctgttttgtttctttactttttattattttttaaaaaattatttgtttgtttatttatttattttgagacagagtcctgctttgtcacccaggctgcagtgcagtggcatgttcatggctcactgcaacctcactctcctgagctcaagcggtcctcctgccctagcatccaagtagctgggactacaggcatgaaccaccgtgcccagccttgtctctacctttaatttttagtagagataaggtctcactatattgcccgggctggtctggaactcctgggctcaagctatccttccgccttggcctcccaaagtcctgggattacaggtgtgagccaccgcacccagcctagtatttgctgttttaatctatctgcaatttgttttagttctctgctttcttgactgttttagctttattataccacatgactcttttaccaaaggtgggatattctttcaagtccattctgaatcagattctgactctgcttctgtccctgcttctagatgtaataaattacccaatatctcttatttttaccttctctacttctcagagattataatagatacttttgaaggattttgtgaaaataattgattctacaaaaatagtttttaaagctacaagtagaaataatttaaatattgcaataaaagttcattttttaaattttattattattatacttttaagttttagggtacatgtgcacaatgtgcaggtttgttacatatgtatacatgtgccatgttggtgtgctgcacccattaactcatcatttagcattaggtatatctcgtaatgctatccctccccctccccccaccccacaacagtccctggtgtgtgatgttccccttcctgtgtccatgtgttctcattgttcaattcccacctatgactgagaacatgcagtgtttggttttttgtccttgcgatagtttgctgagaatgatggtttccagcttcatccatgtccctgcaaaagacatgaactcatccttttttatggctgcatagtattccatggtgtatatgtgccacattttcttcatccagtctgtcattgttggacatttgggttggttccaagtctttgctattgtgaatagtgccacaataaacatacgcgtgcatgtgtctttatagcagcatgatttataatcctttgggtatatacccagtaatgggatggctgggtcaaatggtatttctagttctagatccctgaggaatcgccacaccgacttccacaacggttgaactagtttgcagtcccaccaacagtgtaaaagtgttcctatttctccacatcctctccagcacctgttgtttcctgactttttaatgatcgcccttctaactggtgtgagatggtatctcatcgtggttttgatttgcatttctctgatggccagtgatgatgagcattttttcatgtgttttctggctgcataaatgtcttcttttgagaagtgtctgttcatatcctttgcccagtttttgatggggctgtttatttttttcttctaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttgttgttttagacatgaagtccttgcccatgcctatgtcctgaatggtattgtctaggttttcttctagggtttttatggttttaggtctaacatgtaagtctttaatccatcttgaattcagttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgtgggctcttctttggttccatatgaactttaaagtagttttttccaattctgtgaagaaagtcattggtagcttgatggggatggcattgaatctataaattaccttgggcagtatgaccattttcacgatattgattcttcctatccatgagcatggaatgttcttccatttgtttgtatcctctttcatttcattgagcagtggtttgtagttctccttgaagagctccttcacatcccttgtaagttggattcctaggtattttattctctttgaagcaattgtgaatgggagttcactcatgatttggctctctggttgtctgttattggtgtataagaatgcttgtgatttttgcacatagattttgtatcctgagactttgctgaggttgcttatcagcttaaggagattttgggctgagacgatggggttttctagatatacaatcatgtcatctgcaaacagggacaatttgacttcctcttttcctaattgaatgccctttatttccttctcctgcctaattgccctggccagaacttccaacactatgttgaataggagtggtgagagagggcatttgccagttttcaaagggaatgcttccagttttttgtccattcagtatgatattggctgtgggtttgtcatagatagctcttattattttgagatacgtcccatcaatacctaatttattgagagtttttagcatgaagggttgttgaattttgtcaaaggccttttctgcatctattgagataattacgtggtttttgtctttggttctgtttatatgctggattacgtttatcgattttcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtgtattcagagattcaacttcttcctggtttagtcttgggagggtgtatgtgtcaaggaatttatccatttcttctagattttctagtttatttgcacagaggtgtttatagtattctctgatggtagtttgtatttctgtgggattggtggtgatatctcctttgtcattttttattgcgtgtatttgattcttctctcttttcttctttattagtcttgctagcggtctatcaatttgttgatcttttcaaaaaaccagctcctggattcattgattttttgaagggctttttgtgtctctatttccttcagttctgctctgatcttagttatttcttgccttctgctagcttttgaatgtgtttgctcttgcttctctagttcttttcattgtgatgttagggtgtcaattttagatctttcctgctttctcttgtgggcatttagtgctataaatttccctctacacactgctttgaatgtgtcccagagattctggtatgttgtgtctttgttcttgttggtttcaaagaacatctttatttctgccttcattttgttatgtacccagtagtcattcgggagcaggttgttcagtttccatgtagttgagcggttttgagtgagtttcttgatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttgggatggagagttctgtagacgtctattaggtccgcttggtgcagagctgagttcaattcctggatatccttgttaactttctgtctcattgatctgtctaatgttgacagtggggagttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttatctctcttgatctttgttggtttaaagtctgttttatctgagactaggattgcaacccctgcctttttctgttttccatttgcttggtagatcttcctccatccctttattttgagcctatgtgtgtctctgcatgtgagatgggtttcctgaatacggcacattgatgtgtcttgactctttatccaatttgccagtctgtgtcttttaattggagcatttagcccgtttatatttaaggttaatattgttatgtgtgaatttgatcctgtcattatgatgttagctggttatttttcgcattagttgatgcagtttcttcctagccttgatggtctttacaatttggcatgattttgcagtcgctggtaccggtttttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccaacttttctctctggctgcccttaacattttttccttcatttcaactttggtgaatctgacaattatgtgtcttggagttgctcttctcgaggagtatctttgtggcgttctctgtatttcctgaatttgaatggcctgccttgctagattggggaagttctcctgggtaatatcctgcagagtgttttccaacttggttccattctccccgtcactttcaggtacaccaatcagatgtagatttggtcttttcacatagtcccatatttcttggaggctttgttcctttctttttattcttttttctctaatcttctcttctcgcttcatttcattcatttcgtcttccatcactgataccctttcttccagttgatcacatcggctactgaggcttgtgcattcgtcgcgtagttctcgtgctgtggttttcagctccatcaggtcctttaaggacttctctgcattggttattctagttaggcattcgtctaattatttttcaaggtttttaacttctttgccattggtttgaatttcttcctttagcttagagtagtttgatcttctgaagccttcttctctcaactcgtcaaagtcattctccgtccagctttgttccgttgctggtgaggagctgcgctcctttggaggaggagaggtgctctgatttttagagtttccagtttttctgctctgttttttccccatctttgtggttttatctacctttggtctttgatgatggtgacgtacagatgggtttttggtgtggatgtcctttctgtttgttagttttccttctaacagtcaggaccctcagctgcaggtctgttggagtttgctggaggcccactccagaccctgtttgcctgggtatcagcagcggtgactgcagaacagtggatattggtgaaccgcaaatgctgctgcctgatcatttctctggaagttttgtctcagaggagtacccagccgtgtgaggtgtcagtcctcccctactgggggtgcctcccagttaggctactcggggctcagggacccacttgaggaggcagtctgcccgttttcagatctcaagctgtgtgctgggagaaccactactctcttcaaagctgtcagacaggtacatttaagtgtgcagaggttactgctgccttttgtttgtctgtgccctgcccccagaggtggagcctacagaggcaggcaggcctccttgaaatgtggtggggtccacccagttcgagcttcccggccactttgtttacctactcaagcctcagcaatggcaggcacccctcccccagcctcactgctgccttgcagtttgatctcagactgctgtgctagcagtgagtgaggctttgtgggcacaggaccctccgagctaggtgtgggatataatctcctggtgtgccatttgttaagcccattggaaaagctcagttataagggtgggagtgacctgattttccaggtgccggctgtcacccccttctttgactaggaaagggaattccctgaccccttgtgcttcccaggtgaggcgatgccttgccctgctttggctcacacacagtgcggtacacccacaaaagttcattttatttggcatgttttttcaaagtttttcttttaagaggtggggtcttgctgtgttgcccagacaggagtccattggctattcacaggtaatcatagcacactgcagcctagaacccccgggctcaagagattctcctgcctcagcctcccgagtagctaggactatgggcatgtgccaccatgcctagccagagtttgtttttgtttgtttgtttgttttttgagacagagtcttggtcttgtcacccaggctggagggcaatggcacgatctcagctcactgcaacctccgccttctgggttcaagcaaatctcctgcctcagcctcctgagtagctgggattacagatgtgtgccactatgctggctaatttttgtatttttagtagaaacagggtttcaccatgttggccaggctggtctcgaactcctgacctcgtgatctgcctgcctcggcctcccaaagtgctgggattacaggcctgagccaccacgctaggtccaaagtattttttaatacaagagtcacctagccagtcctttaaggttgtcagctctgtaagtttgcatacttttactatattatgtacttataaatcatatatctggaaggaacctgggagcttatctgattcaattcaagcagtgtgaaatggtttcaactaaaaccacccaggaagtggccaaaccaggcacaaaactatggtctctgtattctattcaagtactattgtcataactacatggaatccattcatcattgacttactcactgaatacaatgttgttgttgttgttgttgttgttgttgttgttgttgttgttgttgtggtttttgatacagggtcttgctctgtcacccaggctggagtgcagtggcacgatctcggcacactgcagcctttaccccctgggctcaagtgatcctcccacctcaccctccccaatagctgggactacaggcatgcaccaccatgcccaactaatttttttatttttagtatagatggggttttaccatgttacccaggctgatctcaaactcctagcctcaagcagttcacccacctcagcctcccaaaatgctgagattataggcatgagccacaatgtccagccgtgagaaaaaaaattttgtttcggagtcttgctctgtcgcccaggctggagtgcagtggcctgatctcggctcactgcaagctccgcctcccgggttcatgccattctgcctcagcctcccgagcagctgggactacaggcgcccaccaccacacccggctaacttttttgtgttgtatttttagtagagacagggtttcaccatgttagccaggatggtctcgatctcctgaccttgtgatctgcctgcctcagcctcccaaagtgctgggattacaggtgtgagccactgcgcccagcctttttttttttttcctgacagagtcttactctgtcacccaggatggagggcagtggcatggtctcggctcactgcaacctccgcctccccgggttcaagcgattctcctgcctcagtagctaggattacaggcgcccaccaccacacctggctaatttttgtatttttagtagagatagggtttaaccacgttgaccagactgatctcaaactcctgacctcaggtgatccacccacctcgccctcccaaagtgttgggattacaggtgtgagccactctgcccagccgagtaaatattttttaagtgctactgtatgccagggtttgtgctagggcctggtgacagacctgtgaatgagaaaataggtattgctatccaggaagtaacaatcgatagggaagggggctggggagggaagtagacaagtaaaccagcaattctttgataaacatatgcacagaatactttgggagtacataagaggatactgtaactgattcttgggtggtcaagaagaacttccaaaaagagatgccctgaatcctaacaagtagaaacacctaaccagggaaactagtaggggtagggaatggacattctgcgcagagcaaactgcatttccagatgcacagatgcactgaagtacaagaacttggcttgttctgtgaaactgcaaatgttctgcatggttggagcttggaatacaaggtagggagcgattacaagtaagattagagagataaggcagaggccagtttatgaagggtttggcatgccgggctaaggaatataaagtacacactgaaggaaatggcatgggaagtggagggtggcagggaataatataatcacatttgaatttgacaatgattaatctgaatttaaggaagaaaatgggttgaagcaaagttaaagtcagggcaggaagactgattagaaggctgttgcattaaactaagagtattaatctatagattttgttactgtaacagaaactcaaataacagtggtttgcacaagataaaacttctttcctcacctaacaggctgagcataagcaatccagggctggtgtagcagttcaagtgagccactatgcccagcccccattcgccagaatttagacacatgaacattgcacagctgcaaggatagctaggaaatgtaggttttattttgtcaggccatgtgcccagtttaaaaacagggatttattaccgtagacaaagggcaggatgaactttaggaccactagcaagcttctatcatactaactaagaaaagaaaaagacctaaactgaagtagtggcggtgacttgggccagtttgagaagtaattgggaagttgagttgataggacttggctatggattagaaatgacaggtgagggccgagatggtgccaaacatgatacccaggtttctgacttgggcacctggagggataatggcgaataacatttactgagcaagagcacagaagagggagaagagattcagggaataagtgaagaatataattcagttttgcacaagctgagtttaaagtgtatgtaagacaggccgggcatggtggctcactcctgtaatcccagcactctttgaggccgagatgggtggatcacttgaggtcaagagtttgataccagcctggccaatgtggtgaaaccccatctctactaaaaatacaaaaattagctgggtgtagtggctcatgcctgtaattccagctactcaggaggctgaggcaggagaattgcttgaacctgggaggcagaggttgcagtgagccaagatcacaccactgcactccagtctgagcaacagaggaagactccgtctcaaaaacaaaaataaataaaatgaagtgtatgcaaggcattcagacagaaatgtccagtagactgactttggaatcatcagcatgtacagagtgtaagaacagatgttacttaaggtatgagagaagacacaatgggtcaactgagaaaaagaagaaaaggctgaggagagaaaccagatttttaaagacaaaagtggagaaggaatcccaaggacaggtagaaaggacaagggaagtaggaaaatgtggcgatgtgtcatagaagccaagggaagagagcttttcaagaagagggaacaataaaacttaattcagtcctgggcgtggtggctcacacctgtaatcccagcagtttgggaggcctaggtgggtggatcacctgaagtcaggagtttgagaccagcctgcccaacatggtgaaactccatctctactaaaaataaaaaaattagctgggcgtgctggcaggcgactgtcgtccaagctactcggaggctgaggcgggagaatcgcttgaacgcaggaggtggaggttgcagtgagccgagatcacgccactgtaccccagcctgggtgacacagtgagactgtatctcaaaaaaaaaaaaaaaaagaaaaagaaaagaaaaattgttcaggagcactgtgaaagatattcccagaaaaaaaaaaagatgcaaaagctagagatttctattggtaggattatttagccatttgctagagtcagggaacctaaatgagggcaataatggcacctattttattggttgttgaaaggataagattaaataattcagggacttaacacatagtaaggcctcagtgacgattagctatttctgctgttgcttttatgattaggattgtttaaaaatctgtttaataactacctatactttacttcctatcctctgtctcttcctcctgctgctgcttactttttttttttttttttccagagagaagatctagctatgttacccaggctggatttgacctcctgggctcaagggatcctcctacctcagccccccacacagcagggactacagctgcacaccactacccagctcccttcttcatgtcttacctgtccttattatcacagtgaataatgcctaatctattagtgaataatgcctaatctattaagagctatgtgaaaaacctaaactctttccatttgcaacccttttggtatggtcaagtcagtggatctggctatcatacaaactcaaatcaactactacaaattcagattggctaagcagattccagccattttaaaagcttgtctctgctctatcctgtatctttctgcatttacatgtaacttcactgtgggtgtccttacagtatatatttttatgagacatcaaacttactaagagtactttatagcatagtatttaggaacttaggggtcagaattaagacattgttactatgtcaccttgagtattttgtttaacttcacaacccttcagtttcctgatcagttaaataattatgataatacaagacatagtagcatcacaggattattatggggcctaaatagataatgtatataaagtatttatcacagtgcctggtacagatgttagcttctgttactactctgattctagcctccctaattctcattcttttttgggggttgcaggggagttcactgtgctgtttgctatatttcaagcctcaaaagacaatgaagttcccaaatgctcttcaaggcagaacaaatataaataatgattctcacaccaaatgtgtgcaaagttcaaatattgcattaatggtgctttttattgtgcaaatcatacgactaacccatcatgtcctttctgtgtcaggaagaacatggatgggaatagaaggatctttgaaatcctaccctctgtgtaaatcagtatctgtgaatttttctcttgttagtactgatttatttactctttctggtgtatctgctctttcccttaaaacctttatgataaaaacatatttgaatgcccactttgtgcctagtattttgctccattctagtaatttagcagtaaatatggctgagtaatgtagacgatcaccataggcagagatgcataaactgaaaactgaagaatagctaggagtcggcgaggtgaagctagatgctgtggccttagattcagttctgtcttctctgaccaataaatttgctgtgttccatgaacagcagctgtggtccattctctttttgtgactttcgtgtggcaagttactttacttctctgagcctcagtttctttatctatataatagaaataaataatatctacctcattgagttaattataaggatcaaattaaatatgtatgcagtaaagcactttctgtagtgtttggcacatgggaagagttcaataggtagaagatattattaatagtttaaggaaagcagttggtgagtgatttttagaaatgttcatatttctaaatcaaacctaagaaattaatgctaaatataggcataatgctaaatataggcataattagctgggcgtgctggcaggcgcctgttgtccaagctactcgggaggctgaggcgggagaatcgcttgaacccaggaggtggaggttgcagtgagccgagatcacgccactgcaccccagcctgggtgacacagtgagactctatctcaaaaaaaaaaaaaaaaaaaaaattgagcctcaaactgaggctcagggaagtaaaataacttgccacaggaaagtcacaaaaagagaatggaccacattcatcatagtgaaaaccttgaaacagtctaagtgtccaacaaaattattcattttgaagtatataaaaagcaatgttttatggcatgccttttgaagcattaagatcatctctataatagtatccctcttatttatttgcattctgacagcagtctatcttgagtagaaaaggatagaattacagcatgtgccatggatagcacatagagaggtgtctcacaaggtaatgtcatcttgcgtctttttagggaaaatttgggaacctgggagctggttgttttattgcctcgtggtttcatattaactcttttaaactgttccgtaaaagtgaatatgtgccctttagatatttttttttgttacagctggcccttaagttttgtcagtagagggtggtgatggggagactttgcaggaggaagtgagttttccttcctggtccatgtgctctctcagcaggtcctacagcattcccagcttctctagcacctggcttctgtatccagaagtcatcagcttcccccggaattgtatgaagcactctggtgaaaatttcccagcaacccagagggtgaatttctggcaagttctagtgaccccattccagcaagcttctttctacctgtgctgcaccacagtgacttatctgccatccattgagccacagtggtgccgtctccaagaaggtcaaaatcttagccatgtgggatggagatggggttatccttggcatgctctctcagccctagaagtagctcttcatatctgctatttctatattttaatttctatattttatttctatattttatttctatattttaattctctttacttctttactactagctaatcccatcttactctcatctccttctttatatcaaatttatactgaacttgccctcctcaaattactatgtaattttctctctcctaattggatccagactgattcatcacagctctaggcaaagctgtctttatattagaagaatcatggataagaaacaaggaaatagaatgctccttgaatatgcgattttggagtcatccaagacctagtgttcctttgtgggttaggtgctaggactctccagctggaggaaggtaattagagatgctgccagctggagctgaagcctactggagacacttacatattgagagaatagtgcaggctgaagctggctaccagcaattgtctcccttctgccttcatggtgactctagtattccctcaccttcaaggcttcccttggtattcagtttttgccaagtctcagaaaaataaaaattacaaggtcactctacccaaagagtggctttccacttctgtttaccaacttgtgtttctcatatctccctggaaactaggaatcaatttggccctggatcacaggtgataaaactctacttcttatgtatgcatcctaggcaagcacccatgaagcctccttcagaaatagtgtcatttcagattgtatctaatgttcctggagttaagttgctactgggttgcagaatctttccagggagaattgactgggaagtgactcagtcagagtctaccagaaggtataaaagaaaactggtgattaacaaggtgtgggcttggccaggcacggtggctcatgccttcaatcgcagcattttgggaggccaaggcaagtggatagcttgagctcaggagtttgagaccagcctgagcaacaaggcaaaaccctctctctacaaaaagtacaaaaattagccaggtgtggtgtcacatgcctgtagtcccagctactggggaagctgaggtgggaggattgcttgagccagagaggccgaggctgcagtgagccaagatcgtgccactagactccagcctgggtgacagaatgagaccccgtctcaaaacaaacaaacaaaagatgcgggcttttctcgagacaatgccccctcccagaaaaatctcaacttttatttagagaataggtttagccttccaccttctctttcttcttgcacccatatccatcctctctgagaggtcttccatttaaagtctcccttgatgtatatttaaccacatttcattggctctttcctttttgttttggttgggggttggagaggagttccataaggaattgatgtgatttttctcctggccatttctctaagaataaccctttctgaatgaggtatgttaatcaattcagagttggtcatcttattcctttgtatgatagaagagtagattttaaaatataagcaatgagtatgccttgctttggggtatctggcactgattaccttcttacagcatcacagttactctctttggaaaccctttcttcaatctcaatccatgtcatggaacttatcctactcttaactctaggaattattcgtgaaatctgacaaattagagtgtcacatcccccggtcacagttattgataattggctcaaggagagtcacaggatccagtacaggccaatgaatatcaagagcaacagtttctctggaacttttaggaacaatgctcttttactgtatttgttaaactgatggggtataaggtgtgctatcttgcctctcagtggctaaagccaacagagacaaaagcagagtgaaacaatagtgagaaatatcatccagatgccttgttatagcctgcactgtctggtatagtagccactaggcacatgtggctattgagtacttgagaggtggctagtctaaattgagatgtgctgtaagcataaaattacactgggtttcaaagatttagtatgaataaaagaatgtaaaatttatcattaataattttttatattgattacatgttggaatattttggatatattgggctaaataaaacatagtaaaattaattttatctacttttttcttttttgtatgccaaataaaatatttaaaattatgcatgtgtttcacatttgtggcttgcattgtatttatattgaatagcattggtttgagcacttagatccagccatgcctaaagttatataactccgaactaataaaggccagtaaatacacatttttgcttatgctatttctttatatcaggagttgaattttttatactgtccactaaaagagttctaattaatatattagctaaggccaggtgcagtgcctcacgcgtgtaatcccagcactttgggaggccgagacaggcagatcacgtgaggtcaggagttcaagaccagccaggccaaagatacaaaaattagctgggcatggtggcaggcacctgtaatcccagctactcaggaggctgaagcaggagaatcgcttgaacccgggaggttgcagtgagccaagatcgccccattgcactccagcctgggtgccaagagcaaaactccgtctcaaaaaaaaaaaaagaaaaaaagaaaacatataatatgtaatatatatatattaggtaaaataattagttcagcaaatacgtcatcccaaacctatttttcccctaggcagaaattggagaagatgcaaaaaaaaaaaaaaaaacagtctgaaaaccttattcctttggagccaataagagcattctgattaggcaatattgcttaagagtagggggaagaatcacttcattttattatgccagtgtcagaaacctaactgaatccagttattaaagtatccctagttgtctgcattgaccaaatagatatataatattaacataatattaatacatgttttcagtcatttctttgatgacttgcattatgggtgagcatttcagtccaaaagaatttcccctctggcttgggctggttcctaaaatgaaacttcataatagaatgttgaagcatggagttcttataatctacaaactgcttgttagtgccttgcaaaaacatacagtttccacttgtcagcacaaaagaattgttttcgtcttcaatctttttttttttttcttgagacagagtctcactctgtcgcccaggctggagtgcagtggcgtgatcttggctcactgcaaacctccacttcccaggttcaagtgattctcctgcctcagcctcccgagtatctgggattacaagtgcacaccaccacacctggctaattttttgtatttttagtagagatgaggtttcaccatgttggccaggctggtctcaaactcctgacctcaggtgatccacccaccttggcctcccaaagtgctggtattacaggcgtgagccaccaggtctggccggaaaatcttattactaacaaagttttcctccaggataatcaaagggataataaactcaaaataatttttcattttagttatctttaatatctctcctgaattccaaagaaattattgagtgtccaaatttaaagacatgcaatgttttgtatgaaatgtgcattttttagttaattggtaatttttttttaagtttagagttatcacttcaaaaagataagttttcctgaaggcagaaacacctttctaactaatgcttgataccccaaatcactactactcctactaccactgctgccagttactatttattaaatgccaggaattgtgtttggtagtttacatatgataccttgcatctttgaaacaatactagacatattgtctccaggatactgaagaagaaatgaggttctttgaggcaaggtggcttaaccgagatcacacagccaggattcaaaatccaggtctgatgtcagagcttgggctctttccactgagttttatgtttttctttactcagttgtggggcaatcttcacctaatttgaggaaccagtaactagccccttttcctcacctgacttctgaataaatgggaaaaaaagatacaggagtaaggcagtcagagccaaaagaaatcaacttgattaggggtaaaggttaagttggagggctaaattgtctgagcaagtgggctttgtaatactgagtccagaattattcagacgtacctacccagttgcaggcagtgctggatctaggcaggccccccttctcaccccaagcactggcagtgcctgtccctacaggaacagaaaaaaaaaacccacgcttcctctcttcagctatttcccaagaggaagaagctaaactgctcatgcccagtttctttttttcaaactcactgatggccccagggtggaatgagtgcagtgttgtcagaagatcaggagcactgtactgatatatacactaatgggctcctgtcaaatggaagaaacatcaggaacaggaaagataacactaatagcatactcacaggttaaatacatctatttgtctacatagaaagtctcgattgatggatttatagctctttctaatattcttgataaaaatttattttttccattgccttataaagtttaagaaattaccctgactatactcagagttttaatggtgtcatcattttatcattacaaagcaattatactaagcacctacctgtatgtaaccttgtatggatactttaatctgtcattgtaccactgctatgatttcaagagaggacatttattttaatagattatgaaacatgagagtataggtgagctcaatgctaatgaaagctcccaaaggcctttatctatcttattcaacactgctcccaagattagtgcctggcacataaagggtctcaataaagatttgttggctaaattaataaatatattaataaaattaataaagttcttcaaattctacatttattctggtgctccatatttttttcttttcttttcttttttttttttttttgagacggagtcttgccctgtcacccaggctggagtacactggcacaatctcggctcactgcaacctccacctcctgggttcaagcaattctccctgcctcagcctcctaagtagctgggattacaggcgcgtgccaccatgcccagctaattttcgattttttttttttttttttttagtagagacagggtttcgccatgttggccaggctggtcttgaacccctgacctcaggtgatctgcccgccttggcctcccaaagtgctgggactacaggcgtgagccaccgcgcctggcccctggtgctccatatctaagttagtgtttacaagagggtcttaactattttcaaaggaatatgttttggaagacttttccaatgggaaaagtactgtatggatgccttaaagggaaaagccaaggatagaagaggcagcatgctcctccttttccaaatggatatttgcgtatattctccttgccttagaattttcttctctccacacagtttccccctccttctttcctttctttttcccctccccttccctcccctcccctcccctaccctaccttactctacccttccctttccttctcgttcttcctcaccaagaaagggttagatgttacacaagaaaagaaaccaatttagagagccccatctacattagaggagtttagggttctctggactggggagctagagtgcgttagagaagactgaagtccccagtttttgaaactagtcatggtatatctcagcatacggcttgctcacgaaaagataagcaatcttttaagtcctcagtggctcctacaagaaacacagggaaaattacaaaataggcaaaatttggtgactcgtttaccatcatatctgctgctttccttctgctcctccaaggattcacaattgttactgctattcccctgtccaaagtcacccatctttattccatcttatctttcccaaagcaccacaccaaggtacttactcccttcttccaatgtatttccatgttagtcaacatattagatagaaaatgcaggccgagtgtggtggctcacgcctgtaatcccagcactttaggaggtcaaggcaggtggatcacctgaggtcaggagttcgagagcagcctggccaacatggtgaaaccccatctctactaaaatacaaaaattaaccaggtatggtggcacatgcctgtaatcccagctattcaggaagctgaggcaggagaatcactttaagccaggatgcagaggttgtagtgagtgagacccaggaaggaaggaaggtaggaaggaaggaaggaagggagggagggaggaagggagggaggaaagggagggagggaaaagaaaagagaaaggaaggaaagagagagggagagagggaaggaaggaagggaagggaaggaaggaaatgcaggaacatgttctagctagcttaagcagaaaaggaatttatttattcattatttatttattgagacagagtctcattctgtcacccaggttggagtgcagtggcgtgatctcggctcactgcaacctctgcctcctgggtttgaatgattctccctcctcagcctcccgagtagctgggattataggcacccaccatcacacccggctaatttttgtatttttagtagaaatggggtttcaccatgtttgccaggttggtcttgaactcctgacctcaagcgatctgcccacctcagcctcccaaagtgctgggattacaggcgtgagccactgcatctggccaggaatttattaaacaccattaaataattcacagaatttcctgggaggtgtaaaaaccagggttgtaagaggccaaattacgtcacagaacaccgggaaaccattactgcctccactactgacattaatgtgagatacgaacacttctaatagaacctctggtactgttccctgggaatctagatgcactttctagttccacctgcttcttcatctctctagccttcacttcaaagcctggtgcaaatgtatatgattagaggagcctaactgcaagggagactgagaaagtgaaatttggcttctattcagtagagaaatcatcaaatataacaagaatattcaaaggtgctgggcagccaaaaagaataacaaagatgtactactctaccccagttagcctctcaactcctactgatctgagccaggttttcagcagattgaagtaattcactccgaattgtggatgactgatggtttctctctttttttttgagacggagtctcactctgtcgcccaggctggagtgcagtggcgcgatcttggctcactgcaacctccacctcctgggttcacgccattctcctgcctcagcctcccgagtagaagggattacaagtgctcatttttttgtatttttagtagagacggggtttcaccatgttagccaggatagtctcgatctcctgacctcgtgatccgcctgcctcggcctcccaaaatgctgggattacaggcgtgagccaccacgcctggccaaggatgactgatggtttcaactccacatgaacatcgatgctttaaaagagtagcttattaacccaaataaactcccagttgttaaaatatttatatggtggaaaatacttttaaaataagggaacatatagtgtttcttttatttcttcttaaaaatgggaccaggtgctgtggctcacggctgtgatcccagcactttgggaggctgaagtgggaggatcacttgagctagccagttctagaccagcctgggcaacatagtgagacctcatctctacaaaaaaatcaagaaaattagctgggcgtgatggcacacatctgtagtcccagtaactgaggaggcagaggctggaggatcacttgagcccaggaggtcaaggctgcaagtgagctgagattgcggctgcactccagcctgggtgacacagtgagaccctgtctcaaaaaagtttcttttttttttttttttgagacggagtctcattctgtcgcccaggctggagtgcaatggcgccatcttggctcactggaacctctgcctccagggttcaagcaattctcctgcctcagcctcctgagtagctgggattacaggtgacaccaccaagctaatttttgtatttttagtagagacggggtttcaccatgttggtcaggctgatctctaactcctgacctcgtgatccacccaccttggcctcccaaagtgctgggattataggcatgagccacctagcccggccaacatttctttaaaaaaaaaaaaaacaactttactgaactttgattaacatacaaaaaactgcacataatgtatacaactggataaatcattaattctttattaaatacacattttattgagcttataatgtgccatacagtagattcggtattgaggaaacctggtccatac

SEQ ID NO: 1131 - DNA, 22360 bp, Homo sapiens
cgtgagccaggccgggtgctcttgggacagctcccactgctcctgtgtgctcccccagcttggcacatgactccctgaattatagtcagttccgtacctgaatctccctctagaatgccagtgccacgaggacagaggacggttccactttgttcactattttctccccagggtctggcaaagttcctgggacttgggagaggtgtccttcaggagcttggcagaagccaaacggcacacttaagtagggcaactgaggtgagtttaatgaaggattctatacaaaaatttggacaaggtatagggaggccacaatacacagtgcagtgcctggtgccagtgagagcagggcactattcccactgcaaggccagacagggcaaggggagggagctgcctgacaagagctgcccttacgtcaagggacacatcagcccactagaccccatcaggagggagccagggcctgactcccctgaccttgctctccaatcttctgcctaaaattccccatcagccaaacacaactgaaaactgaaagacaggggagcctgctgttaataaggtgagcatcccccagaataaagctgggtagagagtggagaatggatatggaagggcaaaaggaagatttataagacagtgggcactaaatatctatgagatgaataaaggaaccacattttacaacaaacggtcattgaaacgctactcaatggaaagagatcatttcggtcactgtctggtgcagacaaatcaaagcccacatgcatcaaaaaggccatgtccgtgtaactccgacacggggcagacagcaaggctgaagcctatggggtatgtggagccggaactgagagatcctgatgtaaatctagcacttgggaaaagggggactagaagaaattcacccacaggcagaggaaaacacaaacacttatctatttttgcctaggctttaagtggtatgggaaaaatctctgagactacaaatcctgtgcttcatgcacaggtttataataccctcaaaatggaagaccccaaaacccaggcgcggaaaattcatatcaggccattgatgccctcaatgttcccggctgaaacaaactcaaaactcctctggaaaggagtgctcccacttcaagccatgaaaagctactgcagagaaaataatccccagtcaagacacactcacattgaaactgcaaggcacacaaggaaatggatcaccttgagtgatagctggcagagctaataaacctctgtatacctctaagaagctccacgcactagtataacccttaaagatttgatgaaatcattactttattaaaattgtttttataaaaaatcaaaatccaaaaaaagcaacaaattttataccagagccaattcggtatatacaagggtgtcttactcttttggaatttgtcttattgtcctaactcagcacattgtcctggtctatgaaaagtcctagaaacccttctaccctctgtaatgtaggagctttaactcaatagggttttttaaattcttttttcttgtctttttttcttttttaattttttccattttttcaagtcaaactgaagaaatatttttcttttctttctaggaatgcatattcaccccccaaggccacttgtctcctgattggagagtattagacaattctcaggatttctttattttccttctttattccataggattgggaaacccagtaggattgggtttaggcatatctctaaagcaccatgtttcaacgttttgatgtaagattgtgccctatttcttgttcagttgctgccagcagatgttatagttttaaaactagtttttggtcattgagatattagaggagggaagagtctgctatcctgctttactcatcttcatctacactacactgtcatcttcactgcaaagtcctgtattaatgtttttagattctataacattttaacaggtgtcaaaaaatcttaagcaccacttcagcttgggaatctctaaatgtaatggtgtttgtgggctggactgatgtctgcgtcttgttgttgttattgtctgtagtaatggagagccgggagatcctggacacttcctgttcatgggcacttgatgcattagctgccccagcagctgattacatttaaacaaggatgtgtgggtgaacccagggagaccaatctcagtggaatggtgggggcagaagccaggctgcagggtgtagagtagggaatgagcagtgatgaagtagaaacagagtttggacaactagtgaaactgcctggaagagggggagaagagacagtaaatggtctgaccaatgtttgaggtcaaagtgggtttgtaatctttatttaagggacagatctgagcatttaaaaattctgaataatctaatagagaggaaaaagttgggactcaaagaaaatgtgggaaaaaatgatgaaggttaaacggaatgagatccagagtgcagggggagagattagcctttggtgttagaggagcaactctgtccatggagagaggaaaaatgtagacataccacagttgcatttgaagttggggcctgaggagttgaggagttctgagaaaagcagaagatgagatcatttcctgagagtaaatgggagtcattagaacgggggtgaagagactggaagctttaggtagcttgaaatagttgatggaaaaattggataaagtgacaatttgtcacactcagaacagctatcagggaatctagaagaatctctggaagctagttgaagatcttaaattaccaatgtatcttgtccacatagctaagcggttttacttatttttatttttttgaaacagggtctcactctgtcacacaggctggagtgtagtagtagtagcacaatcacagctcaatgcaatctctgcctcccgggctcaagcaatcctcccaccccagcctcccgggcctgggactacagacacacaccaccactcccagctatattttgtacatttgtagagacagggtctcgccatgttgcccaagctggtcttgaactcctgggctcaagtaatctgcccacctcggcctcccaaagtgctgggattacaagcttgagcccggctgctaagtggttttaaacagctgttctcggaaacacacactcaaagaaaaaatgtagaggataatttatctaaggctggggcttcaagagaggtcagggtgttgacaagagaatgactaagtggcagactactggatctcagctagataaagagggatgtgatcgtgggaggggctgatagtcagaggctggaaggcttgatgaacaacacatattacacaaagaataaatggagtgagagaaaccaaaggagtaaaagttgtcatcagaaaagtgagaaattttattgtgagaattcagtggtaaatcaatgttaacaaacctcagctgggcactagtggagtgaaaccgaaggccagggagttgagttaatgagctgagacttgggcaccagatgggggtccacatggacaactaagccaccaggatgatgtgggaaactggggtgaatagaagccccttatccatgtgcacaagtcttgaataaaataggggcaaccaggcagtcagtggatgatagcagtgaggtggagcagagagcaatgtagttggagaagtggagcccacagcagtctcctttatatctagaagggaattaatagccaaaaaatggcaccgaggccaaggatgtcaccttctgactcccaaatctgagacagatgtgagagggaaggagtatcctcaagggacaggagatggtgcgaatgtttttggcataaatcaaagatgtcagggaaattgtcagaattcaggttccagagacacagaggaaaagcgtgggagaaagtggaatattgggaggtgagattagggcagaggaagcacaaatcaaagaacgaggaatagaaaaagtcatatgagctgaggagttggccaaacatgacagaatgggaatatgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttccttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaattattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgttttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacgtaggtaaccttttgtcatgagggtttgttgtacaaattatttcatcactcagctatcaagcccagtactcaataggtatcttttctgctcctctccctcctcccgccctccagtctcaagtagaccccggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttctcaagatcaagttagatctctaaaaaaggcatcatcctagcatttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctctctctctctttttttttttttttttttttttttaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggtcatgctaatattagtaagccagggtgatcctgaatttacaaaacatttttctttgggaaatttcacacctcacatgattctgtgtttttacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccgcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatccgggatctcactatgttgcccaggctggcctcaaactcctgggctcaagcgaccctcccacctcatacttctgagtagctggggctgtaggaatgcgcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccgtgccctccccgtcccactctcttcccacagcctcccctccccacagcctcctcccaccattccaaatctgggctgttctctcaatttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgcccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtgggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatgatctacacccgtttcttaaaagtaagccatcgtacttggttctctttaattatatattttcttacatattgtgttcatgtaggcaagtcctgtttctgctaaaagaaggtaagttctaccaaggcggtgtcatgccagctttatttcccgtggcacctggcacactgctaagcacttacatgcttaacaactagattgggaatggtgctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaatgctttgtccttttaagtataacacatacctcaggcctcaccagcacataactacaaaaggttgtcccacttcctttctgtggctgagttagtagaacacaggctcccacctgccacatcagcagaaggtcacctcaacatgtgagctacctccccggagaccccccagatccgtaaggatgatgcatccttgatcctaaaaacattttcctgttcctggtgttcagaattggactccacactcactggtctctttataatcttgcttctggccctttgaggcctcaaagctaccagggccttgctgccaggggacaatcaccactcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacattccaaaggcgaatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactttgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgataggtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctattcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaatttttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttcggcagtcagaactagagcaaagataaatgatcccaggactctgtttagcaggcagtcaggaagtgtgacagtgtggtgggtggcagccccggccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagagggtccctgaacttatcctatagttattcccccagttccagaatgcagaattgagctgagagcagtggctcatgcttgtagtcccaacactctgggaggcgaaggtgagaggatcacttgagccaagcggtttgagaccagcctgggaaatatagtgagaccccatcttttaaaaagacaaagaaaaataaagaaaattgacatggaaaaataatataaaatgtgaataatctcacatctactaaagaaatccaatctgtaattagaactcctcccacagagaactataagcccagtgcccccatcaactggagaaacagaaagaaacaatcttcttaacagaaagcataattggaatagagatactctgcatcggggaagaatccccatattgattctctgatccatagagtgaaggccaagtggaagcctttggaactccctctacctgccaagatactaaacaaaacaacactgcacgtctggaggaattgtagcaagaacttgaaagatgaaggatgatgatgtccacctctctccattcagctcacctatctggtttgtgcagaagacaaataggtgttggaaaatgacagtggaccagtgtaaacttaatcaggcgggggctccagctgcagctgcaggatcaggtgttgtttcatttctgcagctaatcaacccttctcctggcacctggtgtgcagatggcaatttttcttttctattatctgttagtaaagactatcagaagctgtttattttcagttggcaaggtcagcaatacactccaagggaagagcagtctgtctcagatcttaccgatgcctggggatagggagggagtggccccctcaccgtctccaaggcctagtcctctgctcctgctactggcagcaaatccacgcaggtctgcaacaacctcaattcctgcctcctcagaagaaagaattcaattgagggacataagacagaaggagagactgaggcaagttttagcacaggagtaaaagtttatttaaaagctttagaataggaacaaaaggaaggaaagtacacttggaagagggccaagtggacgacttaaaaagcaagtgcgtggtttgaccttttgacttggggttttatacgtcagcatgctttcggggtcttgcgttatttctcccctggttcttcccttggggtgggctgtcccatgtgcctgcctgagcccactggctcaactcctgagatcttatagggaaactactgctcaccagtttcgagtgttttctatctattaggagccggcttttccctgttgccgggtgtgaccaattattactttagaaagacagtcaacaaccgccagaccatcacctgatggtcacctgacactcctggtgtgtggggtatggggagccctctcctgccctgctctttctgactagctacccactataacactcccagagggacctgcacattttgtgctctttgcaagacagtgcctgcccagcacctgtaggcctgctcaccccttcagggtcatgatttttgctttttaccgcaggtacccataagcaaaacatggcattgttcaccatgcttttacattattcacataattttaagttatttacacaacaatgtaaaaccatggtgaaccatgccacatgttgcttatgggtacctgtggtaaaaatcctgctactagctcattttgcagtgtctataatgacaggtaatgctccattcactcctttatgacacttgcaaaaactgagaacataacgcctcccagttaagcaggcatctgggcaatgtgaggagaacagaaatagaccacgctgcatttatctctcttgatgacaggcattgagatttccactttttctggtttcttattatgtctctactgggcattcttacatacatcttgcacgccatggaaagtttctctagggcagtggttcacaaactttttggatacagaatacttttatgtgcttgaaaactgaggaccccatacagctttagtttatgtgggtgtaaggttctagcccaaactgaagtccgaagggagttggtgggtgggtgaggggtagctgaaaaaacacccgaggaatcataggcagtttgaacatggccttatcctctctctgggcacgagccatatgtccagtgtcagcagggtaattataccttttacagacaatagaggctctgaagcaatcacgagctcacgtgagtggtcacctaatgcacctcaagtggcatggttcataatgtgcggagtcgtgtgcctacgctccaaacccactgagtcatggtgcaccaaaaagtggcctcagcctgctcctgactaaagcgcagccatcttccttacactccacccctaggccaggggcatcctccaggtagggacatgtgcccgtagggtggagccctgaatccataatccacagcaacaatacggagagcaacagctcacgactaggattccagctatgctacttatgactatcagggcccagcgtaggccagagcccagggatgtctaccatctctgcagggggtcatcagtaaggctcttgactaccttaatctcctgtgagaccccttgcagggctgctgttatgttctgccaattgtcagggataaaggtacaacattgtgttcctaaaagggcacaggtgcctccttaggcagcagttactatgtctaagaccattcggtttcgcaacaccacctttctgatctgatcaacctcatccattaatgggaagagggccactcaggtgtaattcagagcctgagcagcatgctctgcaagagcagtaacttggcttctacagttgtgacacacactccagggctagtgcctgtcaaggggtaaaaccaccagggtgctcattacacttgcaaaaaccgagagtgtagcacctcccagttatgcaggcatctgggcaatgtgagaacagtggcaggtacatgaggccaccctcaggtataatgtccagtccagtttgcttataggtaaggccaccctgtgtccccacagacccataaactcccagggggcacacagtccatcgaggccccttggtggggccgcgtcttccaccatacctttggtgtggtgacatgtattatgcttacacacactgtgacgggtacccatcccacagtgctattaccccagtgttgctatatgcaccacagtgcctgggccaggggtactgcacgttacctcactagccagccccacccatcataaatgctatgggccagccagggaatggctgtgctgtgggtcttgtggcatcctttgtccaaaacttgccacgttgcgttccaggcatcagccatgggaccccaagtctccagccatgtctggttctctgcagatgctgaatgtatgtgctaaggcaagccatctgcagctgctagaagggcggtgcagatccaacagttggaaacattggtcacttcagtgtaggtgtgggcccagtccacaatgcagttggagcatgttaacctacagttggaatgacagagtaggcataggtactaacagaggaaaatcacatccctcaggtaaaatacaggctaacctttcatccctggataacaatgcagcccccaaggggttctgccctgggcaatagtaccacaccttttcagctccccatggttcctttgggtcctgtattcatgcgaaagtcacaggggagcttgtagtaggccacacagacagtacatttgaaccctggaggaaagtttcttccctggccgttttcctacaaacagttaacttcggggaccattcattgaacacccaaagagtgacatacaagtcatactgtaggccctccccacagggagctacgatggacaaccaccagcagccgggggcttggaggggctatggccacagccaggttttctgttcccctgccttcagggacgttggggcaggcaacaacaggttactgttcatccccatacctggtc

SEQ ID NO: 1132 - DNA, 101628 bp, Homo sapiens
tatgcaagggtatgtaaaagtctatatatagtcatatgacaaaggtatatggtgtattgaatttatacttttattgttcatcactaagacccttttttactttaaaagtgggttatatagacctgtgaaacatgcaacaaaaatgaaaacactgcacctttttgtggttctgtaaacacacaagaaaagtggaggtcaggatccatgctgttggccaggtattaagttggcgttatcagcaatcactgtagtctctgtgagtgctgatgaatctgaatgtcatgccttgggaattgcttttttgactagattactggtttgaggttgttgccgttgtgttttttgtaagagtagaaattcacaagtgcacaacgttggatttaggtaagtggaaatttaatgcaatcacagcagtgcctcatacaaagaaagtgatcaacaaatgtagccatgataagggtcactcgctaggccagttgtcacctacccctctgctggatgacagcccttctgcatctgcactcagctcccgcgtttccggagcttctcttctcagaccatgcagtgcccagagcttcagatctgtccatatccttcatcaacacctcctgaaagtatgagaccttgcagaggcccatgtcttccaggtgttgccaagacagctgagacagagccctggagtcctttcttatcatcccttgatcagggtgtcttatatctgttaattctacaaatagccatttttttaaatgtcatttattttaaaccagtagctcagctgtcctgtgccagctccacaccctcaactctacagctgattacacagttcattattatgctaatttaagaaatgttaaatatatgcaaacctacagagggaacaaacactgtagcaacttaccaactttcccacaacctgcagttaacaattgtgaacagtttgtcattttaacttttccccagtccctggaatttcctcatctctaacccagtctccctcaaccactcatgatgaagtgtgtacccatccaatctgttttggaacattttaaaattattttacttggttttttttaaatcagctttatatatgcacatagtttaaagagtcaaaaagttctgtccaggcatggtggctcacacctgtaatcatagcaatttggaaggccgaggcaggaggatcatgagtccaggagcttgagaccagattggccaacatggtgaaacttcatctctaataaaaataaaaaaaaattagctggatatagcagcccatatctgtaatcctagctacttgggaggctgaggcacgggaattgcttgaacccaagaggcagaggttgcggtgagccaagactgcaccactgcactccagcctgggtgacagaaggagactctgtctcaaaaaaaaaaaaaaaaagaaaaaaagtaaaaagttctgtttttacagaattactgcgtttccttctctccagaggcaaacacttccaattctttatttcatttatttttgagatggagttttgctctgtcacccaggctggagtgcagtggcacgatctcggttcactgcaaccttcacctccctggttcaagcgattctcctgcctcagcctcttgagtagctgggactacggcgtccaccaccaggcctggctaatttttgtatttttagtagagactgggtttcaccatgttggccaggctggtctcaaactcctgacctcagggcgatccacccacctccgcctcccaaagtgctgggattacaggcctgagccaccgcacccggccacctccaattctttcaactgatcctattggcatttaccttcagctctctaaataactttctgactgtggtacttcttttttcagttttagtcattacctattgatatggtttcgatctgtgttcatgcccaaatttcaagtcaaattgtaatccttagtgtggaggcggggtctgatgggaggtgattggctcatagggcagtaactcatgaatggtttagcaccttctccaggtgctgttctcctgatagtgagttctcaggagatctggttgtttaagtgtgtgtggtacctcccccacccttgctcctgctcctgccatatgagaagtgttttccatttttaaaattatagacatttaaattatagacattttaatggatatgaagtcttatttcattgtgattttattggcatacacagcatacacataccgtccacataccacacacatacacttcacacaccgtacatactacatacacccacacatccttttgccatatgtacctaaaataattatgtaattatattgtaattttggttaagtaaatattcagtgtttatgtaactgaggcctgtagtatccttttatatttctccctagaattcattattttcttttctgtaagcttttatgtctgtttcctaattccactccaaattctcagttatataccttttcaatatgcccccaaaccaatcaggccatctagcgtttttcttccagagagctcctcgggaaccaccggctctgctctggtgtggcctgggtgcacagccggcctgctgtgcagttgtgggatctccatggactgtcatccagaagaccccctttcctctctgatatttgatcccgtttcatggatcccacatcttcctttttaaaaaaagttacttcctcattttgccaaagcaaatattctagtatcatccttagaaaggatacatggaaggtattttttaattgaagtgaaattctcataagaaaagtagcagtcttatagtgaacaatgcgttgtatttagtatgttcacattggcaaccaccacctccatccagttccaaaacattttcatgaccccaaagcacaatgcagtacccaataagctggtactttccatgaccccatcccagcccttgctttcaagtttcagccatgtagcggataccagtacttcattcctttttgtagctgtataaaccacaatttgtttatcccctcatctattgattgacatttgggtgtggctgttgtaacagtgctgctatgaacattctcatgcaaggtatctgtttgggcacttgttttcaattcttgtatatatacacctaagagtaaaattgttagatcacatggtaattctatgtttagcattttaaggaactgtcaaattgttttccacagtggccaaaccattttccctgtacattcccaccagcaatatacaggattctaatttctccacatcctcacaaatgcttgttattttccattttttaaattatagacattttaatggatatgaagtcttatttcattgtgattttattggcattttcttaatgactaatgatgttgaccatcatttcatgtacttattgcctatttgtatatcttttttggaaaaaatgtctattcacgttcttgtttttctttttattgttgagttgtaagagttcttttttttttttttaactcatttcccatttgccccaagaatactatgcaggcagcaagctacatattttctttttctaaataagaagtgggttaagagatggcagtctcactctgtcacgcagcctggagggcagtggcccaatcatagctcactgcagtgtcgaactcccaggctcaagtgatcctcccaccttggcctccccaagtgctgggattacaggtgtgagccactgctcccagcctagagatcttaatatattctggacaccaggcctttgtcaataggtttgcttcatcagtaggttgcttttcactttcttgataatgtcatttgacacataatagcttttaatttttttcattacttttcaattattttttccagttttattgaggtacacttcacaaataaaaattatatatatttaagatgtacaatgtaatgccttaatatagatgtacactgtgaaattattatcataagctaattaaaatattcaccacctcacataatacttttgtgtatatggtgaggacacttaagatcaactcttttagcaaatttcaagtatgcaatacagtattattaactctagtcaccattctgcacattagatctccagaacctatttatcttgcaaagctatacagttgtatcctttgatcaacatctctccatttcccccttccacggctctggcaatcactaagctactctctatttctaggaatttgactttcttagattccatatgtaagcgagatcacacagtatttgcctttctgtgtctggcttatttcacttattataatgtcctccaggttgatgcaaaggcaggattttcttcttcattaaggctgaataatattcctctgtgtgtgtgtgtgtgtgtgtgtgtgtgtgtgtgtataaaacatatatatatagatacacatttttatcatccatcctttcatttatttatttgtgtaagttgaactattcttgcattcgtgaaacaaatcgcacttgatcatggtgaatgatctttttaaagtgctactggattcagttttctagtattttgttgcggatttttgcacatatgtttatcagggatattgcctgtaatgttcttttattagcgtattatttttctgtgtttagtatcagtgtaatgctatcctcataaaatgaatgtgaaagcattccttctttttagtttttaagaagagtttgaggagggttgatattagtctttgtaatgtttggtatgcttcagcagtgaagccattaggtcctggccttttcattgatgggagacttgttattactgatacaatcatgtacacattattggtctgttcagattttctatttctttctgagtcagtctttgtaggttttttgctctaggaattcatccatttcttctaagttatccaatttgttggcatgtaattattcatagtagtctcttatgatcgtttgtacttctgtagtatctattgtaatgtctcctctttctggttttatttgagtattctctgtttttcttaatctagctaaaagttggtcaattttgttattttattgaaaaccaactagtagttttatttctttttggtatcagttttttagtctttactatttctgatgtgatctttattatttctttccttctactaacttttgggttagttagttctttgtctagtttgttgaggtgtaatcttaggttgcttatttgagatcttcttttttaatggaagtgtttattggtaaaagcttccctcttaaaaccacttttgctgcatactataaattattggtatgttagtgtgtccattttcctttgtcttgagttgtttttgttttcaattcaaaatcatatttattatgttttaaagcaagtgacttattttagtataggatagattaactcattccaaatgatagctttctccaattaaagctacattgttaaaacttgaaaaaattatccagaatttatctttcatggtgatacttaatttcagtagggcttttcacattttgtctgattggcatataaatcaaaaacaaatatttctttttttattattatactttaagttctggggtacatgtgcacaacgtgcaggtttgttacataggtatacatgtgccgtgttggtttgctgcacccatcaactcgtcatttacattagatatttctcctaatgctatcccttcaccagcttcccaccccctgacaagccctggtgtgtgatgttccccgccctgtggccaagtgttctcattgttcaattcctacctatgagtgagaacatgcggtgtttggatttctgtccttatgatagtttgctgagaatgatggtttccagcttcattcatgtccctgcaaaggacatgaactcatgtcttgattttttaaaatttcctcttttaatatcttcttcgactcattgattgttcaggagcatattgattaatttctatctatttgtggattttccaatattcccccattattgatttctagtttcatacgattatgatctaaaaaaaaaacctgatatgatttcaatcttcttacattttttgactagttttgtgacctaacatatgatctattctggagaatattccctgtgcacttgagaataatgtgtattctactgctgttggatggaatgttctatatatttctgttaggtctacttggctaaagtgtagtttaagtctcgtgtttccatattgattctctgtctggatgatctgtccattagtgaaagtggagctattcaagtgtgctactatgattatattacagtgtagctctcctgtgagatctattaatgtttgttttagttactatatgtaggtactacaattttgggtatatatattaatatatatttataattgctatatatttgtaatgaactgatctccttattattacattcttcttcgtctctttttacagtttttgacttaaagtctgctttacctcatgttgagttgagtttcccttatccaaaatgcctgaaaccagaaatgttttgaattttgaattgtttttgcaatgtttgcattatgatatggtttggctgtgtcccacccaaatctcatcgtgaattgtaaccctcatgatccccatgtgtcaagggaggagcccagtgggaggggattggatcatgggggcggttttccctatgctgttcttgtgagagtgagtgagttcccacaagatctgatggttttataagtgtttgacagttcctccttcacacactcacactccgtcctgccaccttgtgaagaaggtgcctgcttctccttcatcttccgccatgattataagtttcctgtggcctccttagccatgcttcctgttaagcctgtggaactctgagttaattaaacatctttcctttataattactcagtctctttgtagtattctttatagcagtgtgagaatggactaatacaaattatatatttactgtttttgcatccctaaacacaaaaatccaaaatgctccgaagaacatttcctttgaacatcatgttggcacttaaacatttttaattttggagtatttcagatttcagatgtttggattagtgatactcaatctgtataactacccctctatcttcttgtttccatttgcatagaatattttttccatccctttactttcagtctgtttgagtccttacaggtgaagtgagtgtgttataggcatcatatagttggatcttattttttaatctatttggccactgtatgtctttttattggaaaatttaatccatttccattcaagataattatttataggtaagatctgctatcaccattttgttaattgctttctggttgttttgtagacccttcgttcctttattccactcttcgtatctttatttgtgattaagtgattttctctagtggtatgctttgattcctttttatcttttgtatatctactttaggtttttgctttgtggttacgatggtgcttacaaaaaaatcttatagttatatcaggctattatataaggtgtataataacaaaatcctccgagctaaagcagcatgttctaacccaatgcaaagaagctaagaaccttgaaaaaaggttacatgaattgctaagtagaataaccagtttagagaagaacataaatgacctgatctgactgaaaaacacagcataagaactttgtgaagcatatacaagtatcaatagccaaatcgatcaagcaaaagaaaggatatcagagattgaagatcaacttaatgaaataaagcaagaagacaagaatagaggataaagaatgaaaaggaataaacaaaggctccaagaaatatgggactatgtgaaaagaccaaatctacatttgattgatgtacctgaaagtgatggggagaatagaaccaagttggaaaacactcttcaggatattatcaaggagagcttccccaacctagcaagacagaccaacattcaaattcaggaaatacagagaacaccacaaagatactcctcgagaagagccacctcaagacataatcgtcagattcaccaaggttgaaatgaaggaaaaatttctaagggcagccagagagaaaggttgggttacccggaaagggaagccaatcagactaacagtggatctctctgcagaaacccaacaagcccgaagagagtgggggccaatattcaacattctaaaagaaaataattttcaacccagaatttcatacccagcgaaactaagcttcataagcaaaggagaaataaaatcctttacagacaagcaaatgctgaaagattttgtcaccacaaggcctgcctcacaagagctcctgaacgaagcactaaacatggaaaggaacaattggtaccagccactgcaaaaactaccaaattgtaaaggccatccacactatgaagaaactgcatcaactaatgggcaaaataacccgctagcatcataatgacaggatcaaattcacacataacaatattaaccttaaatgtaaatggactaaatgcccccaattaaaagacacagactggcaaattgaataaagagtcaagacccattggtgtgctgtattcaggaaacctatctcatgtgcagacatacataggctcaaaataaagggatggaagaatatttaccaagcaaaaggaaagcaaaaagaaaaaaaaaagcagggattgcaattctagtctctgataaaatatactttaagccaacaaagatcaaaagagacaaagaagggcattacttatacaaaaattaactcaagatggattaaagacttaaatgcaaaacctaaaaccataaaaaccctggaagaaaacttaggcaataccattcaggacatagcatgggagaagacttcatgactaaaacactaaaagcaatggtaacaaaagccaaaatagacaaatgagatctaattaaaccaaagagcttctgcacagcaaaagaaactatcatcggagtgaacaggcaacctacataataggataaaatttttgccatctatccatctgacaaaaggctaatatccagaatctacaaagaacttaaacaaatttaccagaaaaaaacaacaccatcaaaaagtgggcaaaggatatgaacagatgcttctccaaaaaaggcatttatgcagccaacaaacatatgagaaaagctcatcatcactgatcattagagaaatgcaaatcaaaaccacaatgagataccatctcatgccagttagaatggcgatcattaaaaagtcaggaaacaacagatgctggagaggatgtggagaaataggaatgccttgatattgttggtgggagcataaattagttcaaccattgtggaagacagtgtggtgattcctcaaagatctagcaccagaaacaccatttgaccctgcaatcccattactgggtatatacccagaggattataaatcattctgctatgaaaacacatgcacacgtatgtttattgtggcactattcacaatagcaaagagttggaaccaacccaattgcccatcaatgttagattggataaaatgtggcacatatacaccatggaattctatgcagccataaaaaaggatgagttcatgtcctttgcagggacatggatgaagctggaaactatcattctcagcaaactaacacaagaacagaaaaacaaacacggcatgttctcactcataagtgtgagttgaacaatgagaacacatggacacagggagggcaacatcacacacctgggcctgtcaaggggtggagggctaggggagggatagaactaaaagaaataccgaattagatgacaggttgatgggtgcagcaaactaccatggcacgtgtacatctatgtaacaaacctgcacattctgcacatgtaccccaggacgtaaagtctaaaaaataaaaataaaaatagatgggatgaaaagagcatgaaaattttgaagaccaaaaccaaaattaattcaaatcaaaataagtgcagagtttatttttaacaaatgtcatagctatgacaccttaatacagaatttgtcagtcagaccttaaaagcttatacacaaaaataccaaaaatgccaaggtttggcatagctggtagctgggaacagtgtcttcgtttgattgctgtctattatttccagcatgctaaatccttacccacgtttcagcttctaagtaggttgatgcttcactctgtctcccgtccaattaattatttctcatcattccctcaatccaagtaacaaaccttgaaacacgagcatagacaccaggcttattggggcgtgcacagccaagaccccaagaagtgactccttgtaaaatgtatttgtccttctcgaagcaaaccagaggccctccactgtcaccctaaacagaggtaggggaaaattcatgtgagctttaagctgccaaccttttaatatgggatgccatccttctcttatccatatgtacattttcccagtaattcaaatcagaaaggaacttatgagcatattactcaagcatctgcagtgcttaagtacttagcaaagtctattcaacaaaaccacatcacttagttttttcctgggaaaaaaaataatcccttgtgaatcctgcatgcattgcttcctaacttggtgtttcctttagactgggctagcctggacatcattgttaagtgtgtgtaatttgtctcggtcctgtaccctctaccttcctctctactggaaaagccaccacttcagtcactggtgaccagcacacaccaggaaggtgagtggcctgaggtagttatggcacttacggctcccttgctatggatctggaactcaagccccaagacgtctccttagatgatctgaatatgcattcagggacagatctggggagtttctgagcaacacttagactggggtcttccactgacaaaaccttcctgaatttgccactttgggactgacgtctaagggactgagactgagacgggagagcacaagactttgatctattgatcttttcttacctggcaactgtcagtgcctctggccaaatgctcagcacaaatatacttatagtgattgcacacttcattctcaataacaaggagctgggcttccttgagaaggccagtcccaaaggtacctgtgtttaaaaagatgaaagaaatggttactgaggccaaagcttgttcacgaggaaattccagaagaacagagcagtggagctggacctcctgtctgtccgtgaggctgcagaacacaaggcagctcccaatgccactggactctctgacccattaaagtgcaaatgtcatataagattttatgttcccaagacctggattcaacaatctgggctttgtcatgctgctttggggttggttgttgtttgtgtactttttgcttttcttttgaagctatcaaaatgatttttacaatgtaaagagagtctgagaaatacaattgctattctttttatatacttttttcagatttttatatgcttcttttactattacatcataatgcacaatttcctatactgattttttcaatcaatgttatatcatgagtttttaaaaaaatgctacagtcttcataactaatattttaatgaggagtgactgcttaatgggcatgaggtttcctttggggatgagaaaaatgtcctggaaatatggtgacggttgcacaccattgtgaatgtactgaatgccactcagtggtacctgcaaaaatggttaaaatagtaactctatgttgtataaattttattgcaataaaaaagaatagtcatcatttactaagaatcaacctttccaggcacaagctcataatgtggtatatctcacttaatcctcacaacggtcctatgaaacaggcacttgtcattcctgttcttcagttgaggaaactgaggcgtaaggaggttgtatagctcagcttgagtctgggtctgcggagtcgctgcccaaatgcttcctccccatgcgtgttggccccactcttgcttccaaccttccacatgtttgttcataaatttcattcttattccttattactttctgaagtctcagttcccataattatatagacatatttctatctcacagtaacattgccaaattattctctaaaagggtgtgacagtggaaaatgtcactggaaaacaattactttgcctcacccttgtgatattcaatttttaaaatattagctaacatagtaggtggaaattgtcctgattcattttctaatttacacttccttgacaattagggagaagaaatactagggacaattctcctcgttgtagttcttcttttgtgaaaaactgcttaatttccttcgccaaattgaaacagaacctctgctaaagtgccagaggaaatgctgtttttccagatggacatgcccagggatttctcagtgctctcacaaataatccaagtttccaatgttgcaagcccagctctcattagaattttgcaaaactttgcaagcatggcacaggctagaactgaggcactctctcctgctttccccaaagcccttgactgcacttagatcattgtcttcggtgtcagaaaactgacaccgaatctggagtttacatgagcagcgtggaagagtctcttccgcagagctgcatggaggaagctcctcctgactaccgagcattgggcatgggatgcatcacctggactgcacagatgtgtaaaggggcacccttctcaaaatattttgctgaaagttaagttaggtgtcactgctctcagatttgctctctgagcaaggcaaacatcctgataagagggaaaacccaccaggagttgctgggaaattaatgcagtctatgagtatgtgctgccatctcgtggccaatgtagagatggcacctctgagggcagggtgggccacaggtaacctgaggattgaagccctctctgatggcgccctggagacagggccacgggatcagcccagtgattgcagatgagacttacatggatgagccccttggcctcaacaccactctgcacttggtacatccaaatccgggaaggtctggacacatgaaggggagagggggagaattttgacctccttctgagaagctgagaacacccattgatctgatgtcattattaacatgtagaaagttgataagcaggcctgagttatgtatgtggctcctcctggtctagttggtgttctgaaaatccttttctcagtggacatgtgggtgagaccagaggagactgggagcccagtgcaggatggtggttagaaatgtgtggatgggggtgggagagaggaaacagtgagtgggctctggggtcaacacccagctacaccctggttatgtgatgtttatttatgatgatggtggtgatgattaaaccaatggtgatagtgatggtgttaatgatggtgatggtgatggtggtgctggtgatgatggtggtgctggtgatgatgatggtggtgataatggtgatggtaatgataatggtgatggtggtggagtagtggtgatggtggtgggtagtaatgatggttacagtgatcattgtgatgatggtgatagtgatcatggtggtggtgatgatggttacagtgatggtggtattggagatggtgttgatggtgattatgatggtgacgatggtggtgatagtgatggtggtagtaatgataatacagatgaggaaatatagaggatagtgatgatggtggcagtgataatggcagtggtgatgatggtggtgatggtgatagtgatgatggtggtggtaatgttaatggtgatggcagtagaattgtggtgatggtgatgttggtagtagcggtggtaatgatgatggtggtggtgatggtgatgtcatgctgatagtagtgggacagtggtgatggtgatggtggtagtagtggtagtggtagtaatgatgatgatggtggtggtgatggtgatggtgatgatgttgagagtgatgatattggtgatggtggtggaatggtggtgatggtgatggtggtagtagtggtagtggtagtaatgatgatggtggtggtgatggtgatggtggtaatgatgttgacagtgatgatattggtgatggtggtggaatggtggtgatggtgatggtagtgccagtaagaatgatgatagtggtggcgatgatgttgatggggatgatggtggtagtggtggacggtgatgatgatgattatgtgtaatcttaatcctcacaattatctcatatgtaagatgagaaagcggaggctaaaagagattaaataactgcccaatgtcacatggaagatgggagagccagaactcacacccagatccttatgattttagcttcatgctttcatcagttgaggtatcatagaggctctgtttgctttctggctgcccagcagctttttgccctacctcccataatcctcttgaaggatctatctaacttttgccccttatgggtattagtggggtcttgccttcacctccaacatggaacaattggtgcaggtcagagccagtcagtgatgggttcaggggcaggactgtgacccaagtttgacttctcagagtgggcagactattgttcacataattgggagagtggcctttcttattctttcccggtacagccacagcaccacagcatctgcagccatgggaatgtcacctttgtgcccccaaatagtgcctactccatgattgggaggacctgggatttggggccatcatgtgagcctgaaaactttgcagctcactaagaatttcccttgttttgcttaatccaatttgagttggattttctgtcacttgcaagaaagaatcatgttagatataattctattctttattagtagtaggagctgccatgatggagtgcttaggatgtgctcagcacttgatgcactttcttattatttcccccataacagccctgcagcccacatcagctgaggaaacaatcagcgagagctcacgacttttctaagtcctgacagcccataggcaggagccagggttccaattcaggtttgtctgtaccaccctccaccttctctgagccccagcttcctcaatggtaaaataggaacaataatacctaactcacagtggtttgtagcatttaaattttaaaatatgcaaacaccaggagcagcctcccacacccataggtgcccctcatttgccaagtttccttttacctggcctcagtgctcccagactcagcagtgcagaaaaagggaacaaggagtcaaggaggtgaggttttaaaaataataggaaaatgacagaaaaagggaagcctactttgaaattatctaaacctgtggtttttaatctttttaaaaacacaaaaaacattttatcaaatcaaagcttatgcaaaaggctgatgtgcaaagcaccatttgaaaatgctggttttacagataagggattagagccaagtggtacaaagaggtaacgtgtctagttcaggtctatctggcaagtggcagagtcagaacagttttccagggccccagactcccagtgcccttgcctgcacctctgagaaagtagagctgagactttaagacagtttcagttttcctactgccaagggggtaaggctgacggatataattattgtcagggcataccgcaaagagaagaaggaatccataaaatgtagtacaggtgctgataccacatcatgcacaaaaatattccctctcttgctctcacccatcaaccaataccaaatgccatcctagacttggggccatgggaactgtctgcctctcccccagcttcaggtcccctgcctaacaccctcacacacacattagacatgtgggtatttgggaagaagaatagtttaattacaacttttgtcgttactgttttgcaccatgtttagaaacgcagtctgtctaatttcacatgaaaaataatctaacacccttaacttgagggctgggtcaaaaccccacttacctggggaagcaatatgaatgctgaaattatgattaagagactcaaagacctctactggtgtttgtttttgttgtaagggaaacatacaatcattacaaaaaaaattaaaagattctgaaaacaaaaaagagagagactcaaggaaatggcaccgctccccttgcccaagtcccttgaagactgattatggagacatagacaggtgtccaggcaaagtcaggagtgggtagaccacattcatgggtaggaatttgtacaactatctccaaaatgctcattttgtaacatgcactgaaggtcaaaaacaatttgttacgtgggcaatggaattgatctcaccttgggtttctccccagccagtgatgtaacattcagtcctggcggtgaccatgtagtctggggatggcagacaagctggcattactttgtcagtgatgacggcaggcctgtaaggaaagtattagcagttatgtttcactgcccagctggaagtggcagtacctacaaccaggcatccctgccttgaagccccagagccctctgagctggcactgccttgcttcactgacacagaacaatgtagaacacagcgtttcaccctcacatttgcctgtggttgcctatggactacacagatgtaaggtttcatttgaaaggcatcagttgcatgcaagaaactgagggtggccttagcctttgaaagtagggatgacaaaggcacacttctcatgtatattctgtgcacgattggaatctcatgccaagtgtgtcctttcatattaattgaagagggcattgatgactgggcagaatgtctggctgagacatcatcaagagggtataaaattgcaaatgccttgtgtgcccagagcaagttgctccatctggatcctccacttcctcctcgtgaatgttactaaaccgtggtggtaagaatgcagtaaaatgctagacatcaaatgaaagaggatgggaaataagcaccttgcatgaactaaatggtattgttttccaaggacattcatataccttagaatcccagggactcttaaagattagaactctggtttttagacctgattctactttagtaagttcaaggggataaaggaatggaaatgagaaatgccgtattctgaccaaaaatcatcattagcaccaactttgaagcagacacactttctgcttctggacactagaaggcccagcctgtgatgcagatgtcctcactctacaggttccctcatggagcactaaatgccctagactctaggggtgtggggatgtgcggtgggaactctaaactcaaaacgtatcagcctatcagagaatgcctccaaaaccccacatttcctaagtgacttgttcaagccatcagaacaccccagctctctgaggaccatgaggagcagagatcttgtatttgcacatttgctgggatggtggggaggaccctggggagcaagagggagatcagctactgtttataaaggctgagccagaaaggcccttctctccttcctagagtgtcagaggattccaggacatcacccctcagttcacagacccagagaagctgccatgggcttgtgaccaggcccaggagagcagctcaggctcctgcctgccccatgccttcccaaccaggccatgctcatccctgtctgcattgacaccctgccttccagagccaccagcacagcgagcaccccacatgccttgtcacctgtcccaaacctgcctctcctacaaatactgtttcttagctgattgtactgtcacctaggtccaaatagactaactttaagtgatgtaagcaaaggtatcactttgtcaggcttaataaaacaaaatttcaccaggaaagagaaaatcaaagaagacaacaataatattattatttgcatttgtaaattgtatgttgtgtgggttttttttttttttgacattgtggaatatttctgttcatttgttttgttttcttttcttttgttgagacagggtcttgatctgtcacccagcctggagtgcagtggcacaatcatagctgcctacagccttgaagtcctgggctcaagcaattcttcctcgtcagcctcctgaatagcagtgattagaggcgcccacactaagcatggctcgatatggtggtttttcaagcgctttgaaatgcaatctcatttgattctctccagcatattattatgaaaggagaatagttagcctggaataacaacctttccctgatcatgaatgtggatgaactggtgaacattaagtaagttttacgggtaacagggtatctctttttccacgtgaggaaacgaatccttctgcctttttaaagagcacaactaacatgtggcagggctggggttgaagattgatgctgtccccaaagcccttgagcctttcatgtgatagacagttcctccccactgccatgcagtggccatggcccataaaacccagacataaagcaaatatcttcaccagcgtggggtgaagaccacaggtgagcgagtacctgcttagctttagcaaggcaatatctgcttgtgtgggctccaagaacagcctagacacttctatttcctgaacatgagattcgaggttcacttcttggtgtgcacccaggatgaccttgtaggatgaaggccttgaggacctagaaaagatgaggatgtcaagagaaaaatatggtccagccccttcaggtatcctctgtgccatgaacttggcgctgtccctctgacaccctcggccacccagaatcagtgacttatgagtggcaagaaacaaaattcacaatttgctggaaactgacagttaaggtctgttctcaatctgtttcatcagagactgtgatatagtttgtatatttgtccccacctaaatctcgtgttcaactgtagtccccagtgatggagctatggcctgtgaaaggggtttggatcatagaggtgcatccctcttgaatggcttgggccacatcttcatggtgatcagtgagctctcactcttagttcttgcaaagtctggtcatttggtattgtgcagcacccccaccccatctctctctgtctcttgctcctgctctggccatgtgacatgcctgctcccactttgccctccaccatgattgtaatcttccttaggcccacacagaagcagaggagatgacagcatcctgcttcctgtaaagcctgcagaaacatgtgccaattaaactcttttctttataaattattcagcctcagatattgctctagagcaatgcaatacagattgatgcctctggtagtgaacagctctgtcctgcggtttatacaggtccaaaaaatcacttgcactgggtcttccctctgcagattccctctagaaacacttccctcctctctcatccaattgccctggaaattctgcctcaggattctgcatgcattccctggttcctagtgttccttccagaaaaggaagagaggtggggaggaaggaaggggagggtgggaagaaagaagggatggaggaagagagggaggaaaaaagtcttgaagataagaccccatgtcagttttcccttaaacgtacttcttcaagcagtgagcagcagtcagcacccactctggggatattaaggtgcctccacagaagtgctttccaaacctagaaagaaaacatgccaaggctttggtcaaattggatggtttgttctacttcattgtacagaaagccaggaagacaagttcactcagttttgatcatgttcatattcccaaagcaaaggactaccgcccaacgtcaggatagtagaaacttcgagctgtgctccagtagtgagatttttcagaagggcccatctgtgccactttttttgatgcctgaggcaagaataggcacagcctgtccccaggagagcaaagctaagtgactccagaatgaagctctatagctgtggctttcaccccacagccctggactctgacaaaagtgaccagcccaagaccttcccaaggtctctttcattttttatgacaagatctatgcaaggtcactcttcaaggagccagatacgatcctgagcagcagtgactcatgagggtcttctgatcttacctgaaaagtttacttttgggggatgtttcttgactcacttactttctaggactgtgtaggcagttgatagatcagaataatggtgtgagccacttggagccagattgcaacgaagaggaatagagataggaagtgcatgatggcagtatgttgatagtcagtgaggacatagaccaccacacagtttaggaaagaatgaatctgaaatatgtggaaggtgaaagctctgtagagcaagaagttacaaacgataaagtaaagaaaaatcaactcaacagcagagtgaaatgcgatgcgatcaggtttgtcgatggcatttcacaaacttacagaaggaagtctctttagaggagaacagcaattgagcacaggtgccctggtgtagaaaggagatgaggaagcaaaacatgcaggcagatgggtctgtgtcctatgtgttcttcctaagagacacccaagcaaactgaacttacgaattgcatgttccactgaaacgatacccaaaatgtccaggttctgtgggttcggactgattactcttcatttatggggatcacaacccataatttgttcatgtgtttgtgaatagatgaatagcctcggcattgaattcaatgattcacaaaagtgtaaaaaaaaatctgtgcctgtgatagactgtaggtaagtttgctcttgtcctccctcactgcaaagtgtcacatttctaaaaacttccctttcttttcatctgacagtgagacaatggatatccatagaaaccctcagagcatcttcaatattttccaaaagtattggaacttggtgcaaatcactgtgcctacagattttgatggaactgcccagatcaagaaaaagatttgtattttggctattttccaagtagagaacctataataatataactttttttaatttttctatattttttcctccttcagaaaacagagaggcaggtattgatgcatcagctgtgtgggttctgtgtaaatgtagaagggttttgtggggcttacatggaaggacagtatagatggtttctgggcctgttcttaccttgttctgagactgacttgccagggccaggaatgtgggtgggccacacacccccctacaatgcttccaggacatttcttcggctccacttgaggcttcccacaatcaaatgaagaggatgctgtggcacaaggtgggaaaagaagtcgcatttgagtccaagttagcaattgtgtcgtttaattcaggacgaattccaagcactagtttttcacatctcaaaggtgaaattaaatggtaaaatcataaacactctttagatttttctttctaagtttaaaaagtggtagtaaacaacaaaggacactctcctttcaaggaaatataagttctttctaaaccatgtaaagtttactgaaaggcacaaaggattcttttgcatgtgagtctctgtgtgtggacatatgtgcatgtgtgtatgtgattttatgtagcaaggataactgtcctatgttgaaatgttgccttctctcagccagcttcaggacagttcttctggggagcctcccatgactaactgactgctgtgggggtaatttacacacatgtgcctctattcttcttttcctcctccctgccttctctctgcagcaagcccacaaggtctctggaggtagggaaagtgtcccatctttggtaccacccatcaatgcctacaacagtgcaggggctacagagggtgttcaaaaatgcttctctgttgtctccagcccttcaaggtcttcaaaactataaatattaatatagttaataattattcatataattattaataacaactgcaagaggaaattcctccccaaccaaccagagattctacactccagtgaatctggaacctgagttttccaaataacttttcatttgctgtgggttgttttgagaatctatctatagaagtcttttgtaaaaaagaagcatggcatggaatgcaatcatcttttctagtgctgagctcaatttctgctagtatgccttacatacagtaaacatgcatcattgtactaaaagagtaactacagaaattataccctactcctactattcaaaataaaactgaatgtttctatttatttttacttatttattattcgtactgaatgtgttggtggaaatgaaatagttattaaactctttctccaaccagaggctctaactttctcaatcatgagtcaaacctgaatatcccaccaaccacatccttctgcaggaaacagtcctcaggatttccaagtgtctgatgggaaccctcctcaccaggcttggggttaacctcacttgtcttacatcaaagtaaggtggggaacctcacagtccattggaagaaatcttgttcccattcttccttctttctccaatctctaagaacctgattctcatacatcctcaatgtgggtgaggacagcagaattgcacctgggaagctactgcacttcccttccatgggagtcaaaggtgcatgagtcccaggcactactgtgggtgtttgaggcaggtaagtcagactgggcttaaattcaaggcagcctgtcaaggatagagagcccaggcagtgagaggcagtggcgtgtactagatggggccagaagcggagaactggaactgaccccatcaagagactttgaggtagaggaaccaccaagatgcttctgcaatagcaccgacaaaatagaacaaaagcacccactcgagaaaaaagtcagctatcaactcacactaaatccagagaccacaatgccacattataataatattggccaagtagaatctttcctatcaccctaacctctccttcttccctcttgctctccccaggagtggcccaaatgtgacgatgggcagtgtggctcccatgatcttcatcactgccctgtaccacctccccaggcaatctcaggatgctggtcttcagtggacttggaggccaaccttcttcccccagctcaaggtcccttcacatggcagacccaaccacaagcaaccaaattacacaaaagaaaagtccagggtggtgttctgtaactcggacagacaagttgattggtcagcaggaagaaaatagggaacaagtacaagtggctttttttcccccatggatttgttaccccaatcatttaagatctaatgtcaattccccttcccctgatccaagcctcatactcccaataagagtctcagagcaatgaggaaggaacctaacaagcagtctctaagcaatgtcgctaatgggactcatgagtagtaatcttacgagaaaggccatctggggctaaagagctgcactacccttcattgatttcctaggatggccatctgaggtttacaatgtgcattacatgcttagctgtttcctgctgctcgtattttttttttcttctcagctgcagaagaggacagtttttcatcataatgactctaaatttgtttttcatgcatcccacgctagacaaagaagggttcggtgggactatcccgggctgattagatcacctctaagtttgccctttgggaatttgacatttattttatttatgtgtgtgtggtgggaggggcgggtgttttcctaacaaatggggccaatagtagggcaggttcaaggtggccatgatgaaaagcaggctctggtggagagggcagccatctcctccccagaagcactcagctcaaaagccattttctgttttttttgcttttttttttccaaatccatattaaggaagcagtttccttaccaaaacagaaggcaacttaccacagagagggatatcacagtagtcaaaaagttttcttggattcattgtgtagcaccagggaccattgatgtcaccatcagggttacggcagtactgaaaacaagcaggcatgtaagctccagctcacgtggagcaggagagggagaagatattctaaggcacacacatttcacatctattcttagaagacaaaagggagcgttccttcttcctttctatcattattatattttttgacaaagttatttctttctatgctgtaagccatcagtcatagtcaaaaggagttatgaggccacacccttaaccagggtgtggtgaccctgaagggtctttggagaatgtgccacttctccaggagcttgacccactggaggtcttagagctagagcctcagaggacagtgggacatcattgatgagctttgtccctggggcgctgaggggtcttctacctgataaagcctgtttgctgttgattcagaaatgcttacttccatgcattatgcaccatccacagccaagacacacaaaggcagtatcatccttagcttcctgtgatattgtgatagaataagaaatgtatattgggtctctgccccccagttcttaacacagagctcctaaatcccttggagtttcctgggtgaagggagctgcaatgaagcaactcttggtgggttcctggatagccccaggggctggttgccaagggaaccaaccatgtgacttgagggttggaactgttcagccccaccctccaacctccagggagggaagaggggccgaaggtgagccgatcaccgatggccaatgatgtaatcaactgtgcctctgtaatgaagcctccataaaaacccaacaagactgcacttggagagcttctgggttgctgaacacttagggtactggggactggtgcactggagagggcatagaggctctgagccccttcccacgtgccttgccctgtgcatctcttccacctggctgttcaccaggatcctttttaatatcttttataataaatgggtaaataaaagtaacgtgtttccctgagttctgtgagccactctagcaaagtaatcaaacccatggagggtcatatagaaaaacagatctttatccagctgggcagaagtacaggtcacagcctgcaacttgggattggcatctgcagtggggcagtcttgtaggactgagccttaacttgtgggatctgacactgtctccagatagagtgtcaggaccgagttacattgtaggacacccagctggtatctgctggagactcgcttggggtgtgaggagaaatccccccatatctggtgtgagaagtgttatgttacatgggtgtgagagtgggggaacacagacactttggtttttcctatatctcagtcttccctattcataggccccaaagtaaaccatcacagagaatgcatgaggctaagggaagtctcatggtgacctgatggcccatccaaatcttttctagaaaaatctgacttaagcctcatagagggcatctctgactactagaacccagagcagtgtggttccccaacttttttggcaccagagaccagtttcataaaaggcaatttttctgtgcacctggggtgagggggcgatggttaaaggatgactcaagtaccttccatttatcgtgcactttatttcaattattattacattgtaatatataatgaaataaatgtgcatctcaccataaggtaaaatcagtgggagccctgagctaattttcctgcaagtaggtggtcccatctgggggtgatggaagcatgacagatcatcaggcattagattctcataaggagcatgcaatctagattcctcacatgtgcagttcacaatagggtttgtgctatgataatctaatgctgcctctgatctgacagctggcagagctcaggcagctatgagagtgatgggaagcagcagaaaatacagatgaagctttgtttgctcccccgaagctcacctcctgctgtgcagcccagttcctaacaggccacagataattaccagttccagtaccagtaccagtaccagtactggagtggggacccctggcttagaggacaagcactagaaacgagaaacagcacccaacaatggaaacagtaaagaaatgtcaaaagagaagaggcctgagaacccccacacgcgtggggctttgctggcctgtgctgcttgcactttccatgctaaggctaattacgcttagcctcctgaagtctttccagtattttcctctgcccctcttctgtttgaaaagatttgtcagcaaagggaaaaagagtccaaatcaaagtggcttacatttttttccagacctgcccatttatttgtccctggaatgaacgtgctgtgtctatggggctcctgggcagcccattcctggcatggcgtcccagtaacagtggttgccttcttgccccggtatcctttcccattcccaaacatacagtctgtagaaaaaaataaaaataaaacagatgattacagacagccaggcagccacatagacccaggacgatacagaatcaatgcagtcatgtcaggcttctctaggacgacagaatcaggggccacatccctcaggagccacaacgctgaagactgcaatgaacactattttaagaaattactggaaatgcttattggcttggaaataatcacacagttgacagcatgttagaataggaatttgactgggacactgaaataacccattttagaataaggtgagtggttaagttgagcaccctggaggttttgcgccagtcctaaagtcactactcccacaagttgtgccaaaaatcacagctctggctttcccagggacggcactgagacttccttggtcatggcagaacctcaaccaacactcgagctcccgtgtagcactaaaggcttctgcatcagtgtggtttttcatgtcttttcatcccgttgtccaagcacatagagaggtatgtgctagacaaggtaagacacagacttcttaccttgttcagaaggaggccctaggcttggaacctggatgacagtcggaggagcgaccacagtcccttctgtgtctgagcatcgcgtcaggttgcagtactcccacctgatgctggggtccatggtaaaacaccaagggcctgtatcggcatctggattcctgcagtagttcattgtcaggccactggaaattccaaagcaatacaagttacaggaggcggaagaatattcagggacatccagcaccctctacattttgttctaacaaagtcttaacaagtgtctttgaaatattcccattaaaggtatcatacaattgccacaacacaaatgttcctcaacttcccatttgtgcatgcctttcaaagatagatgataatttttattttaaaatatcaaaagtagtatatgcttgtattagcccgttctcacattgctatgaggaaatacccgagacagactgggtaagttacaaagaaaagagttttaattgactcacagttccacattgctggggaggcctctggaaatttacagtcatggcagaaggcaagggagaaacaggcaccttcttcacaggcggcaggacagagtaagtgcaagtaggggaaatgccagacacttacaaaaccatcagatctcaggagactctctcactgtcatgagaacagcctgggagaaactgcccccatgatccagttacctccacctggtcctgcccttgacacatggggattatcaggattatagagattacaagtcaagatgagattttgggtggggacatagccaaaccctatcaatgctccatataaaaactgagatcatacataaatgtgcaaaagaaaggaaccagaataccctccttctaccttctgccaagcacatacccctagaggaaccggtatacggattttgatgtgtgtcttatagattgttatgcatatacaaatgcgtctatacctgtctaactctctgtatctctttctacaggactgtatagtaacatgtgagttggaactaacatatatttctccaaggaggaaatgccatccaagatgatatcattcccaggccagcctcccttactctctgtactagtcgtgtagctaaaaggctctgcatttacagtgaaaaacaaccatgaaaatagcattattgtcaataccacttcaggtgggtcaagtgagtttgagtctaaaagacttataaaagctgacctggaagactaggtcccaggcaggatgctgtttctctaggatgggttcctgggcagaacctcctctcctactctcagtccatcctctactggccacagccactgcgggactgacagaagggggatgagatgaaggaacagtgggacccaaggcataaagtgagagggctggctagactatgggatctgaaaaggtccaccagctatggagggttcagaaaaacaattgagtaagtgagaggcacaggctgggtgctttggctcacgcctgtaatcccagcactttgggaagccaaggcgggtggatcacgaggtcaacagagcgagaccatcttggccaacatggcaaaaccccgtctctactaaaaatacaaaaattagctgggcgcagtggcgcacatctgtagtcccagctactcatgaagctgaggcaggagaatctcttgaaccctggagttggaggctgcaatcagccgagattgggccattacactcctgcctggcgacagagcgagactctgtcaagaaaaaaaaaaaaaaaagcacagccggtgaggaccccggtggtgggggatcttggagaatgtgctccccttcgttcctcccaggaatgttgctccaacctctcagaatcctcacattcatgacatgtggctgtctgagaaaccttgaaatgtattatgtaccgtgggaatgcaacattgtctctgtagagactctatacatgtgacccagtctcaagcccagattctccattccagcaagctggttctccaagcagctggctgtgttagcaagtatagtatatgagggaggttattgatctattttcaactgaggtatattttcatgtatagtcaaatgcacagatcttagatgtagtttgatgacttctgatgaacatgtacacttgtgtaactcacacttcaatcacaatacaggacatttacatcaccccagaaaaaaacttcgttttactgctcaatcaatctctgctactctcttcccatggccagaggcaaatgatattggtttctttcaccagaaattagttttacctttctggaaccttacatcaatagactcatacataatgttcatttttgttatctggcatctttctttaatgtaatatttttgagcatcttccatactatttgagagtatcaaaaacatgctcccttttattgctgaacagtatgccattgtatgactagttcacaaattatttattcattttcttattgattgacattgaaattgtctacagtttggggttataaaaaataaagctgctatgaatattcttggagatgtcttcgtggacttatgtttccatttctgtggggtaaatattcacaaacaggattgcaggtttgtagggtaaaagtgcatttattgaacttttggagaaactatcagactgatttcaaaagtggttgtatcattttgcactttcaccagcatatgagagagtttcacatccttgctctacatcagtgacatcagttactgtggtgtcttcttaataatatccatgtccattgggtgtttggtgacatctcatgatgattataactctttatttttcatggctgagatactggacattttttcaggtgcttattggctatgtgtacatctatctatccccaagaaatgcctattcaatctgttgcccattagttgtttgtcctctgtttagtgagtgggagaaatgttcctatattctggacacaagccatttgtcagatatatggacagagagcatttttcttctcatgtgttacttgcctatttattttcttaacaatgacttttggtaagcatgagttttcatgaaagcccacattataatttgttttattttatagtgagtgtttacagactcctgcctcaaaaaagtttgccttctccaaggttgtgaagattttatattttttcatggaactttcatatttcaggttcagttttagctctgacacttaggtggaagagatatcaaaataatttgagatgaaaagcaaaagtcaagttctgcttttgttttgtatcatggatatccaaatggttcagaatgattttgtaaaacatttttgtctccattgaattgctttgccatctatacggaaaatccatttaccatatatgtatgtgggtctggtggtgggccatccctttttaggtttgcatacttttttggccaataacacatatccttttttttttttttttttgagacagtgtctcattccatcatccaggctggaatgcagaggcatgatcaatgctcactcatggctagacctcctgagtcaagcaatcctctcacctcagcattccgagtagctgaaactacatgtgcaagtcatcacatcgatctaattgtttattttttgtagagagagggtctcactctgttgctaaggctggtcttgaacatctgggctcaagccatcctccagactcagcctcccaaaatgttggggtaacaggcatgagccaaggggccaggccaataccacatgtcttgattcctgtacttttataagtctttatattaaggtatataagtcctccaatttttttttccaaaaaaggactgttgcaatagtgcttgggtgtgggtttcatccaaagatcaatttcacgagaactgatatggagtcttttaatctataagcatggtgtatatttagatcttttaattctttcctcaacattgttttctagtgcaaggtgtatagtccttgagcatagtgtgtgaaatttatcactaaatattttttggttttgatactattgtcagtgatattgctttaaaactttaattttccaaaggatcatagcatgtatacagaaaaagtttttgcacattgagcacgtatatacttttgtttcttcaatttgaccacattcacttattagtctttaggagtgcctgcatccattaatcaccactccagcttatttatgattcaggttttcatggtatatatcctttttcatattttggtgtttaaagtagatctttacacttaaagagtatttattctaaaaagaacacacttagctgtggtttttattcaatttacaatctctgccttttatttgtaatgcttaatccttttatatttaatatactcataaggtagttcagtttgtgtctacaataatgctatgtattttctgtttacaccatatcttttatattctttattcctctttttcttccttcttttgcataaaaggactattcctcttactatccattcctctcagtttaaatttttttggttgtcctaggatttataatatcccaccttaaactatcacattcaaccatctattaatattatataacttcatggataatgcaaaaaactcattaacagtatacttccagttatcatctgcattatttgtgctactgtttttatgaattttactactacatacgttgaaacaacaatatattcctattattttaattaatatcacaaattgtcctttaaatacatttaaaaattagataaataagagtattttatattgacattgccatttgccatttccagggctcttcattacttagtatggattaaagttcccatctggtattatttttcttctacctgaataactttccttaaaatcttttaatacagaagcctgccttggaaacattcttttgtttttttgcttgtttcctctggaggtggcagaatacgtatttacatcacgtttattttaaagggtttttttgtttatttgtttgttttggctggacatgtcgtcctaggttgatctgtttttatttctctttatcactttaaagatgttatgccattgtttccaaggagaaggcatcggtcactttcattactgtccctctatgtaaatgatattgttttcctctggcttataagattatccttgttatctttgatgttggacgatttatctataatgtacccaagtaaatcatagagttttgcttttaaaaatactatttctgattcattgagcttcttgactgtgagtttatcattttcttcatacgtgtaaagtcttcagccatcattgctttgagtatttttttctgtcccaatatctccttcccgtccttctgtgacttgctttacccatatattaaatcttttgctattttcactgatatccttaaggttctatttatttttttcagcctttctctctctctctttctctctctctctctctctgtgtgtgtgtgtgtgtgcgcgcgcgcgcgtgtgcgtgtgtgtgtgtcttacagattgtatggctttcattgagttatcttctggttcactttttcttctgtaatgtataaactaatattaaggccatccagtgagtattttattaaggttatacttttttgtagttctttaatttccatttggttgttttacgcatttgcttttttttatattctgcatttgtttccctcatgttcatgttttctttaaatctttgaacacaattatcatatatacagttttaatttctttgtcaattccatcgtttctactatttcttggtctatttgtattgactggtttttctcctagttatggatcacactaattgctttttcctgcctcataaatttttaaatgatgtcactccttgtgaatgcaacattacagagcactgtaatcatgttatttacctccagtgatggttgagttttcttctgtcaggcagttaatttacttggagatcatttgggtccttttagacttggtttttaagctttactagggtgtttctggggtagtctttattctaagaaggcataaatcctactcctaaagtatgacttttctggggtctctactgaatgcccgagatgttcaatgaggtgtctctcctcgggctgatcagaaccccggtatcccccagtgctacgtgagctctggcgtcaccattgagctcactgtttccctgaatttgtcctttccccagtagtggttctctgtcccactttgtagaatttctccctgtgcatatgcagtttatattagacttccatgcatattccttcagctccttttcaccacaaattctttctcattattacctagcatagaaaatacacattttcttagctatcccaaactccagtctctttcctcagttcagcaagactgctgtggttggctttggctccaattccttgcccttcagtccaggaaggttctccaggaagaaagtcataatagttacggagttgcgctcattcatttccttttctaaattatctcagtcctgtactgtctcttgtccaacatgtggaaagtgttttttaatatcttttatagtcatttatggcagaaagccagtttttgtcagacctggttttttgtccatgtacctgcccattttaatctccatatctgtttacttcctaattctcatctacattcttgcttttgctcttcctctcctggcaacccatatcccttcagaaaactggagcttagaacccagtgtgttcacacaggtttatatatattaattatattatattatattatattatattatattatattatattatattatatgttagtgtgtgtgtgtgtgtgtgtgtgtgtgtatgtgtgtgtgtcctgcaaattgtatggctatacagcttgcagctgtgcaggctatagggtatttggtcatcagtcagggacagacataaaaaccttgcatgtttccctagaacatatatatatatatatatatgtgtgtgtatatatatatgtatatatatatgaatactagtctgtatgaacatatatatatgaacatatatatgaatactaacttatatgaacatatatatgtatatatatacatactagtctgaataaacacacctggttatatatatactcatatacatgtgaattatttacttgtgacccatgacaaaaatggcaaaaagccttcatttcagagaagggaggttagaatgatagaattgcatgggtgaaagagtgcattgatcttttatgagccttgtagaatggcactctaagtatttgatcatttgatctcttgagctttatattaaaaagacctcatcagctccatgtagccttctgcttccatcagactattagaaaagatagcaagcctaaaatacctattctctcagactctttgatcaaaagcaaagttgtctggacattttgacacaccttctgggtctaagggaaatttgtcctaacaagttagcttgaagcaaggctcttctaggaggaacttaagttggctgttgctcctcttacaagtaacatcaaagacatactcatttgggtagttttctggggtcctctgatgccggtgtggtgtcatggatgaccaagattgacatgtccttcctgtgacagtggtggagaatgtgcctcgataactctggccattaccatggtagcactgccggaccacaggggtttgctcagttggtgctgaaaatagacaaaatcaagctgagtaactactagtatgcagaaacatgtgaagcaatttatgacacaaacaggacagtagtttcagaattatgactgttctctttagtatactcacaagcagaaggacatgctgaagcaaaaacaatagattaataacattctaatattttaataagttcttagaaattttatattcaaaacctggtgggaaaaggacctatcagtgctcttacaattggaacaaagactcatgtgcaagctctttcgtatggctctctactggttgttcatgaaaacaatgaggcaggaaaccagacgatgatggattaggttatgcaggctgtatggtgattggctgtcagtaggggacagacatgaaaaccctgcacagttccctagatgattgctcctgaaaagccaaagccttaagcttctggtggacggggcagttcatggtcctgcatctagtacttggaggcaaagacacattgcttcttagagaaggatggaggctaaaatcttattcccttacagtagagacagggaatcctcttgttccagcatcctgcattgcaacaaagcagaagtctactacccttcctctcaacacacaccaaagatgcacgttccatgagaagaaggcacaagaacaccaagaaattcctgccttccaagcataggtgtgcagagcctacctaagactgaaataagccagagaaatagtgtattctgtggtatttactgccaaatagccccaggattagatggaataaatatcatcatattaggtttccccaggatgacaaactcagcggccacatacctcagcaactgcaatgctgaagattgcaatgaacactgtccattttaataaatgcctggaaacactcactagtgtgaaatttggcacaaatttggcctgatgttagaattggaattttgtctggaacaccgagataacccctttcataacaaagtgagtggtaagtcaagtgcccaggtgggtttgcaccattcctgaagtcaccgcccacgcacgttgcgccaaaaattgctccaccagagagagtgctgaggcttctttccacctgccataccctcaagtttctgtgtagcatggaaggcttctgcatcagtcagattttccatctcttttcatcccaatgttcaaatgtgtagatatctggccacagacttcttacctgcttcagaatgagcctccatgcttggaactggaacaacagtgggagtctctaggacacctgattctgtttctgagcattgtgtcagattgcagtactcccacctcacacacggatcggttgtgtaacaccagggttgtttcccagaatctggattcctgcagtagttctcggtcaggccactgcaaattccaaaacaacacaggtcacaagaggcgggaaaaaattcaggggcacccagcgctgtctaaactttgttataacaaagtgttaaaaagtgacgttgtaatattcccattttaggtacaataatattccgaaaagcaaaaacggtcctcaagttctaaagaaccatgtaaatttccaagatagattataatttttattttaaaatatcaaaattggtctatgatccataaaaaaactgagatcatacataaatgtatacaagaaaaattcggaatatcttcctccttctgccaactgcattcctccagaataaatgacatagattttgaagagtgcattttagatttttttttttttttgtgacggagtctcgctctgtcgcccagactggagtgcagtggcgcaatctcggctcactgcaaggtctgcctcctgggttcaagccattctcctgcctcagtctcctgagtagctgggactacaggcgcccgccaccacgcctggctaattttttgtatttttagtagagacagggtttcaccgtgttagccaggatggtctcaatctcctgacctcgtgatccacccacctcggcctcccaaagtgctgggattacaggtgtgagccactgcgcctggccttagatttttttaatgcacataaaaatgtattggtatctgtctcattctctgtgtctctctctaggactctgcagtaacatgtaaattgtaactgatatatattacttcagggaagaaacaacatccaacatgataccattcccaggccagcccctttatttactcacagtgtagctaaaaggctctacttttagagtgaaaagcaattatgaaaatagtattactgtaaataacataccaggtagatcaagtgtgtctggctttacaagacttataaaacctgccctaaaaaactagctcccagacaggatgccatttctctaggatgggttcctgggcaggaccacctctcctgctctcagtccatcctctgctagcggcagccactccgaaactgagggaatggaggatgagatgaaagaacagtgggacccaagtcataaagggcgatggctgggtagacaatgggatctgaagaggtcgagtggctacagaggagtcagaaaacaatggagtaagaggcacagaaagcaaggaccctggggtggagggatcttagagaatgcactcccattcatgcctcctaggaacgttgacccaacttgtcagaatcctcagattactaacctgcagctctctgagaaaacctgaaacgtattatgtgccatgggaaagtttagagactctatgcctgtgacctagtctccagcctagacccccatttgagtaagctggttctccaagcaactggatgtgctaaaaggctgagcgtttaaaagcaatttctgccctttttacagttgagatatactttcccacagagtgagatgcacagatctgcaatgttgtttttttgatgattttggatcaacacctatacctgtggagcccaaactcccatcaccacacggaacatttctgtgaccccagaaactctcttgagtccctacccaattaatctgtgctacccccttaccactgccagaggcaaatacattggtttctttcaacagaaattagtttttcctcttttggaggaaatgtaaatgatctcatgtaaatgaactcatacagaatatacatggcttctttcctgagtatatttttgagctccatccatgctatttaagatactcagtgctgaatagtattcaagtgtaccagtaggttgcaaattattttttcattttgttattgatgaacattgaaattatttttacagtttgaattataataaataaagctcctataaatattcatatagaactctttgtggacttactttttcatttccttgggataaagattcaggaatagaattgcaggtttgtaagatagaggcatattgatggaactttttaagaaaccatctgactgattttttaattcgttttatcattttgatcttccaccagcatatgataagagttttataatctacctccacatcagtgacaccacttattattatttccacccatttactttaagtttatgtgagtccttatgtcttaaatgagtctcctgaaggcagcagatggttggtgagttcttattcattctgcagttctgtatcttattattattatactttaagttctgagatacatgtgtagaatgtgtgggtttgttacataggtatacacgtgtcatggtggtttgctgcacccagcaacccatcatctacattaggtatttctcctaatccaatccctcccctagcctcaactccccaacaggcccctgtgtgtgatgttccccttcctgtgtccatgtgttctcattgttcaactcacacttatgagtgagaacatatggtgtttggttttctgttcttgtgttagtttgctgagaatgatggtttccagcttcatccatgtccctgcaaaagacatgaactcatcctgttttatggctgcatagtattccacagtgtatatgtgccacattttctttatccagtctatcattgatgggcatttcagttggttccaagtctttgctattgtgaatagtgctacaataaacatacgtgtgcatgtgtctttattgtagaatgatttataatcctttgggtatatacccagtaatgggattgctgggtcaaatggtacttctggttctagatccttgaggaatcaccgcactgtcttccacaatggttgaactaatttacactcccaccaacagtgtaaatgtgttcctctttctccacacatcctcttcagcatctgttgtttcctgactttttaatgatcgccattctaacgggcatgagatggtatctcattgtggtttcgatttgcatttctctaattaacagtgatgatgagcttttttcatgtttgtcagccacataaaggtcttcctgtcagaagtgtctgttcatatcctttgcccactttttgatggggttgttttttttttcttgtacatttgtttaagttgcttgtacattctaaacattagccctttgtcagatggctagaccacagaatttttctccataggttgctttttcactctgatgagagttttttgctgtgcagaagctctttattttaattagatctgatttgtaaattttggcttttgttgccattggttttgctgttttagtcatgaagtcttctcccatgcctatgtcctgaatggtattgcctatgttttcttctagggtttgattttttgtttttgtttttgtttttttgatggagtctcactctgttgcccaggctggagtgcagtggcacaatcttggcttgctgcaagctcaacctcctcagctcatgccattctcctgcctcagcctcccaagtagctgggactacaggtgcccacgaccacacccagctaattttttgtatttttagtagagatgggctttcactgtgttagccaagatggtctcgatctcctgacctcgtgatccatccacctcggcctcccaaagtgtcttctagggtttttatggttttaggtcttacatttaattctttaatctatcttgagttaatttgtgtataaggtgtaaggaagggatccagtttcagttttctgcatatggctagccagttttcccaacaccatttattaaatagggaatcctttccccattgcttatttttgtccagtttgtcaaagatccaatagttgtagatgtgtggtgttatttctgaggcctctgttctgttctattggtctatatatctgttttggtaccagtaccataccatgctgtttttgttactgtagccttgtagtatattttgaagtcagatagcatgatgcctccagctttgttctttttgcttaggttgtcttggatatacaggccctttttctattccatatgaaattgaaagtagttttttctaattatgtgaagaaatcaatggtagcttgatggggataacattgaatctataaatcactttgggcagtatggcaattttcacaatattgattcttccaatccattagcatggaatgtttttccatttgtttgtgtcctatcttatttccttgagcagtggtttgtagttctccttgaagaggtccttcacatcccttgtaagttggattcctaggtatattttattctctttgtagcaattgtgaatgggaattcactcaggatttggctctgtgtctcttattggtgtataggaatgcttgtgatttttgcacattgattttgtatcctgagactttgctgaagttgcttatcagcttaaggagattttgggctgagatgatagagttttctaaatatacaatcatgtcatctgcaaagagaaataatttgactccctctcttcccacttgaatacctttatttctttctcttgcctgattgccctggacagaatttccaatactatgttgaataggagtggtgagagagggcatccttgtcttgtgctggttttcaaagggaatgcttccagcttctgctcattcagtatgatattggctatgcatttgtcataagtagctcttattattttgagacatgctccatcaatacctagtttattaagagtttttagcatgattgggtattgaattttatcaaaggccttttctgcgtctattgcgataatcatacggtttttgtcattggttctgtttatgtgatggattatgtttattgatttgaatatgttgaaccagccttgcatcccagggatgaagccaacttgatcatggtggataagctttttgatgtgctgctggattcagtttgccagtattttattgaggattttcacattgatgttcatcagggatgttggcctgaaattttcttttcttgttgtgtctctgccaggttttggtatcagaatgatgctggcctcataaaatgagttaggcaggagtccctctttttctattgtgtggaatagtttcagaaggaatagtactagctcttctttgtacctctgttaggatttgactgttaatccctctggtctgggctttttttggttggtaagctattaattactgcctcgatttcagaacttgttattggtctattcagggatttgacttcttcctggtttagtcttgggagggtgtatgtgtccaggaatttatccatttcttttagattttctattttatttgcatagaggtgtttaaagtattctctgatggtagtttgtatttctgtggcatcattggtgatatcccctttattattctttattgtgtctatttgattcttctctattttcttctttattagtctggctaggcttctatgtattttgttaatcttttcaaaaaaccagctcttggatttattaattttttaaagggttttcgtgtctttatccccttcagttctgctctgatcttagttatttcttgtcttctgctagcttttgtatttgtttgctcttgcttctctggttctttgaattgtgatgttagggtgttgattttagatctttcccgctttctcctgtgggcatttagtgctataaatttccctctaaacatggctttagctgtgtaccagagattctggcacattgtgtctttgttctctttggtttctaagaacttatctacttctgccttaattttgttatttacccagtagtaattcaggagcaggttgttcagtttccatatagttgtgtggttttgagtgagtttattaatcctgagttctagtttgattgcactttggtctgagagactgtttgttatgatttccattctacggcatttgctgagaagtgttttacttccaattatgtggtcaattttagaataagtgcaatgtggtgctgagaagaatgtatattctgttgatttgtggtgtcgagttctgtagatgtctattaggtcagcttggtccagagctgaattcacgtcctgaatatccttgttaattttctgtcacgtcgatctaatattggctgtggggtgttaaagtctcccactatttttgtgtggaagtctaagtctctttgtaggtctctaagaacttgctttattaatctgggtgctcctgtattgggtgcatatataagtaggacagtcagatcttcttgttgcattgatacttttaccattaggtaatgccctcctttgtctcttttgatctttgatggtttaaagtctgtttcatcaaagactaagattgcaaccgctgctttttttttctttccatttgcttggtaaatattccttcatttctttattttgagcccatgtatgtcttttcaccctgagatgggtcttctgaacacagcaaaccaatgggtcttgactctttattcaatttcccagtctgtgtcttttaattggggcatttagcccatttacatttaaggttaatattgttatgtgtgaatttgatcctgtcattatgatgctagctggctattttgcccattagttgatgcagtttctttatagtgttgatggtgtttacaatttggtatgtttttgcagtagctgttactggtttttcctttccatatttagtgttttcttcaggacctcttgtaaggcaggcctggtgttgacaaaattcctcagcatttgcttgtttgtaaaggattttacttctcctttgttataaagcttagtttggctggatatgaaattctaggttgaaaattattttctttaagaatgttgaatattctacatctttctttggcactggatgtttcctgcccttgaacatcagactccaatttcttcagttttggaattcagactggcttttcttgctcctcagcctgcagacggcctattgtgggaccttgtgatcgtgagagaggggaggtttcaagatggccgaataggaacagctccagtccacagttcccagcatgagcaaagcagaagatgggtggtttctgcatttccagctgaggtactgggttcatctcaccggggcttgtcagacagtgggtgcagcccacggagagtgagccgaagcaaggcgggatattgcctcacccgggaagtgtaaggggtcagggaattccctttcctagccaagggaagccatgacagatgtacccggaaaatcgggacactcccaccctaatattgcacttttccaatggtcttagcaaacggcacaccaggagattatatcctgcacatggctcagagggtcccatgcccacagagccttgctcactgctagtacagcagtctgagattgaactgctagcacagtagtctgagaccgaactgcaaggcggcagcaaagctgggggaggggcgtctgccattgctgagacttgagtaggtaaacaaagcgaccaggaagctcaaactgggtggagcccaccacagctcaaggagacctgcctgcctctgtagactccacctctgggggcagggcatagctgaacaaaaggcagcagaaacttctgcagacttaaacatccctgtctgacagctttgaagagagtagtggttctcccagcagagagtttgagatctgagaatggacagactgcctcctcaagtgggtccgtgacccccgagtagcctaactgggggacacctcccagtaggggccaactgacacctcatacagctgggtgcccctctgagatgaagcttccagaggaagaatcaggcagcaacatttgctgttctgtaatatttgctgttctgcagcctccactggtaatacccaggcaaacagggactggagtggacctccagcaaactccaacagacctgcagctgagggtcctgactgttagaaggaaaactaacaaacagaaaagacatccacaccaaaaccccatctgtacatcaccatcatcaagaaccaaaggtagataaaccacaaagatggggagaaaccagagcagaacagctgaaaattctaaaaatcagggtgcctcttctcctccgaaggaacgcagctcctcacgagcaacagaacaaagctggacagagaatgactttgatgagttgagagaagaaggcttcagacgatctgtaataacaaatttctccgagctaaagaaggatgttcgaacccattgcaaagaagctaaaaaccttgaaaaagtttagatgaatggcagactaaaataaacagcatagagaagaccttaaatgatctaatggagctgaaaaccatggcacgagaactacgtgacacatgaacaagtttcagtagttgattcaatcaagtggaagaaagggtatcagtgattaaagatcaaatgaatgaaatgaagcgagaagagaagtttagagaaaaaaaggagtaaaaagaaatgaacaaagcctccaataaatatgggactatgtgaaaagaccaaatctacatctgcttggtgtacctgaaagtgacgaggagaatggaaccaagttggaaaacactcttcaggatattatccaggagaacttccccaacctacaaaggcaggccaacattcaaattcaggaaatacagagaatgccacaaaaatactcctcgagaagagtaactccaagacacataattgtcagattcaccagaaaggtcgggttacccacaaagggaagcccatcagactaacagcagatctctcagcagaaactctacaagccagaagagagtggcagccaatattcaacattcttaaagaaaagaattttcaactgagaatatcatatccagccaaactaagcttcataagtgaaggagaaataaaatcctttacagacaagcaaatgctgagagattttgtcaccaccaggcctgccttacaagagctcctgaaggaagcactaaacatggaaagaaacaatcggtatcagccactgcacaaacatgccaaattgtaaaaaccatcgatgctaggaagaaactgcatcaactaatgagcaaaataaccagcgaacatcatgatgacaggatcaaattcacacataaaaatattaaccttaaatgtaaatgggctaaatgctccaattaaaagacacagactggaaaattggataaagagtcaagatccatcagtgtgctgtattctgaagacacatctcacgtgcagagacacacataggctcaaaataaagggatggaggaagatctaccaagcaaatggaaaacaacaaaaaaagcaggggttgcaatcctagtctctgataaaacagactttaaactaacaaagatcaaaagagacaaagaaggccattacataatggtaaagggaccaatttaacaagaagagctaactatcctaaatatatatgcacccaatacaggagcacctagattcataaagcaagtccttagagacctacaaagagacttagactcccacacaataataatgggagactttaacaccccactgtcaacattagacagatcaatgagacagaaagttaacatggatatccaggaattgaactcagctctgcaccaagcagacctaatagacatctacagaactctccaccccaaatcaacagaatatacattcttctcagcaccacatcgcacttattctgaaattgaccagatagttggaagtgaggcattcctcagcaaatgtaaaagaacagaaattataacaaactgtctctcagaccacagtgcaatcaaactaggactcaggattaagaaactcattaaaaactgctcaactatatggaaactgaacaacctgcacctgagtgactactgggtatgtaacgaaatgaaggcagaaataaagatattctttgaaaccaatgacaacaaagacacaacataccagaatctctgggacacatttaaagcagtgtgtagggggagatttacagcactaaatgcccacaagagaaagcaggaaagatctaaaattgacaccctaacatcaccattaaaagaactagagaagcaagagcaaacacattaaaaagctagcagaaggcaagaaataactaagaccagagcagaactgaaggagatagagacacaaaaaaaccttcaaaacatcaatgaatccaggagctggttttttgaaaagatcaacaaaattgatagaccactagcaagactaataaagaagaaaagagagaagaatcaaatagatgcaataaaaaatgataaaggggatatcactaccaatcccacagaaatacaaactaccatcagagaatattataaacacctctgtgcaaataaactagaaaatctagaagaaatggaaaaattcctggacacatacaccctaccaagactaaaccagaaagaaattgaatccttgaatagaccaataacaggctctgaaattgaggcaataattaagagcctaccaaccaaaaaaagtccaggagagattcatagccgaattctaccacagatacaaagaggagctggtaccaattcttctgaaactattccaatcatagaaaaagagggaatcctccctaactcattttatgaggccagcatcatcctgataccaaatcctggcagagacacaacaaaaatgagaattttagaccaacatccatgatgaacattgatgcaaaaatcctcaataaaatactggcaaaccgaatccagcagcacatcaaaaagcttatccaccatgatcaagttggctttatccctgggatgcaaggctggttcaacatatgcaaatcaataaatgtaatccatcatataaacagaaccaaagacaaaaaccacatgattatctcaatagatgcagaaaaggcctttgacaaaattcaacagctctccatgctgaactctcaataaactatgtattgatgggacatatctcaaaataataagagctatttatgacaaacccatagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcagttaggaaaagaggaagttaaattgtccctgtttgcagatgacatgattgtatatttagaaaaccccatcttctcagaccaaaatctccttaagctgataagcaacttcagcaaagtctcaagatacaaaatcaatgtgcaaaaatcacaagcattcccatacatgacttcatgtcctttgtagggacatggatgaactcccattcacaattgcttcaaagagaataaaatacctaggaatccaacttacaagggatgggaaggacctcttcaaggagaactacaaaccactgcttaatgaaataaaagaggacacaaacaaatggaagaacattccatgctcatggataggaagaatcaatattgtgaaaatggccatactgcctaaggtaatttatagattcaatgccatccccatcaagctaccaatgactttcttcacagaattggaaaaaactactttaaagttcatatggaacaaaaaagagcatgcattgccaagacaatcctaagccaaaaaagcaaagctggaggcatcactctgcctgacttcaaactacattacaaggctacagtaaccaaaacagcatggtactggtaccaaaacagagatatagaccaatggaacagaacagagccctcagaaataataccacacatctacaaccatctgatctatgacaaacctgacaaaaacaagaaatagggaaaggtttccctatttaatacatggtgctgggaaaactgcctagccatatgtagaaagctgaaactggatcccttccttacaccttatataaaaattaattcaagatggattaaagacttaaatgttagacctaaaaccatataaaccctagaagaaaacctaagcaataccattcaggacataggcatgggcaaggacttcatgactaaatcaccaaaagcaatagcaacaaaagccaaaattgaccaatgggatctaattaaactaaagagcttctgcacagcaaaagaaactaccctcagaatgaacaggcaagctacagaatgggagaaaatttttacaatctacccatctgacaaagggctaatatccagaatctacaaagaacataaacaaatttacaagaaaaaaaatcaaacaaccccatcaaaaagttggcaaaggatattaacagacaattctcaaaagaaaacttttatgcagtcaagagacacatgaaaaagtgctcaccatcactggccatcagagaaatgcaaatcaaaaccacaatgagataccatctcataccagttagaatggtgatcattaaaaagtcaggaaacaacagatgctagagaggatgtggagaaataggaacatttttacactggtggtgggactgtaaactagttcaaccattgtggaagacagtgcggtgattcctcaaggatttagaactagaaataccatttgacacagccatacaattactggatatatatctaaaggattataaatcatgctgctataaagacacatgcacacatatgtttattgcggcactattcacaatagcaaagacttggaaccaacacaaacgtccatcaatggtagactggattaagaaaatgtggcacatatacaccatggaatactatgcagccataaagaaggatgacttcatgtcctttgtagggatgtggatgaagctggaaaccatcattctcagcaaactatcacaaggacagaaatccaaacaccgaatgttctcactcataggtgggaattgaacaatgagagtacatggacacagagtggggaacatcacacaccggggcctgtcatgggatggggggagtggggagggatagtattaggagatatacctaatgtaaatgaagagttaatgggtgcagcacaccaacatggcacatgtatacatatgtaacaaacctgcaccttgtgcacatgtaccctagaacttaaagtataataatagtaaaaaagaatgttgaatattggcctcccactctcttctggcttgtagagtttctgcaggaagatccactgttagtctgatggggttccctttgtgggtaacccaaactttctctctggctgccctcaacatttttttccttcatttcaaccttggtgaatctgacgattatgtgtcttcaggttgctcttcttgaggagtatctttgtggtgttctctgtatttcctgaatttgaatgtggtattctctgtatttccttaatttgaatgttggcctgtcttgctaggttggggaagttctcctggataatatcctgaagagtgttttccaacttggttccattctcccatcactttcaggtacaccaatcaaacgtaggttcaatcttttcacatagtcccatacttggaggatttgttcattccttttcattctttattccttaatcttgttttcacgctttacttcattaagttgattttcaatctctgatatcctttcttccacttgatcgattttgctattgatacttgtgtatgtgtcatgaagttctcgtgctgtgtttttcagctccctaaggtcatttatgttcttctctaaactgcttactgtagttagcaattcctctgacctttttcaaggttcttagcttccttgcattgtgttagaacatgctcctttagctcagaggagtttcttattatcttctgaaaccaggacccacttgaggaggcagtctgtcccttatcagagctctagtgctgtgttgggggatctggtgctcttttcagagctggcaggcaggaaactaagtctgctggagctgcactcacagccaccccttcctccagttgctctgtcccagggagatgggagttttatctataagcttctgactggggctgctgcctttctttcagagatgccctgcccagagaggaggaatctagagaggcactcttgctacaatggctttgccaagctgcagtgcaccctgcccagttcaaacttcctagcggttttgcttacactgtgaggggaaaacctcctactcaagccccagtatttgtggatacccctcctcccaccaagcttgagcgtcccaggtcaacttcagactgctgtgctggcagcaagaatttcaagccagtggagcttagcttgctgggctccatgggggtgggatccactgagaaagaccacttagctccctggcttcagccctttcttcacgggggtgaatggttctgtcttgctggcattccagggaccactggggtatgaaaaaaaactcctgcagctagcttagtgtctgcccaaatgccagcccagttttgggcttgaaatccagggccctggtggtgtaggcacccaagggaatctcctggtcttcaggttgcaaagaccgtgggaaaagcatagtatttgtgccagaatgcactggtcttcacggcacagtccctcacggcttcctttggctaggggagggagttccctgaccccttccacttcccaggtgaggtgacaccccaccctgcttcaggtcaccctctgtgggctgcacccactgtctaaccagtcccaatgagatgagccgggtaccttggttggaaatgcagaaatgacccaccctatgtgttgatctcacggggagcggcagactggagctgttcctattcagccatcttgccagccaccaactctttttgtatcctttaagtggagcatttaggccatttagattcaattttagcattgaaatgtgaggtgccactgcattcatcatattctttattgcctccgtactttggttttgttttttgtttttgttttttaacttgtacttttgttttataggtcctgtgtgatttatgctttaaagagattctgttttcatgtgtttctaggatttgtttcaagatttagagctccttttagcagttcttctagtggtgacttggtaatggtgaattctcttagcatttgtttgtccaaaaacgactgtatctttccttcatatatgatgcttactttcgctggatacaaaattcttgactgataattgttttgtttgaggaggctatgatagggctccaatcctttatagcttgtacagttcctgctgaaaaactggctgttaatctgatagggtttcctttatacattacctggtgcttctgtctcacagctcttaagattcttgccttcgtcttaactttgcataacctgatgagaatgtgcctaggctaagatctttttgtgatgaatttcccaggtgttctttgtgctgcttgtatttacatgttctttgtgtttcttgtatttgcatgtctaggtgtccagcaaggccaggtaagttttccccagttattcccccaaatatgttttccaagcttttagtattgtctttttcctcaggagccacgattattcttatatttggtcatttaacataatcccagacatcttgaaggctttgttcatattttcttatcctttattctttgtctttgttggattgggttaatttgaagtccttgtctttgagctctgaatttattttttctacttgttcagttctattgctgagactttccagagcatgtcacatttccaaaggtgtgtccaaagtctactgaattttttattgtttttttattaagctatctattttgttgaatatttcaccttttacttcttatacctttttttttttggatttccttgcattgggctttgcctttctctggtccctccctgattagcttaataactaacctcctgaattctctttcaggtaaatcagggatttcttcttggtttggatccattgctggtgaactgggagtgtgatgagccttgttttgtcatattaccagggttggttttctggttccttctcatttgggtagactgtgtcagagggaaggtagggctgaaggctgttgttcagatgtttttatcccatggggtgttcccttgatgtagtactctccctcttttcctatggatgtggcttcctgtgagctgaactgcagtgattattgcctgtcttctgggtcttgccacctagcaagtctacccagctctgggctggtactggggactgtctgtacagagtcctgtgatgtgaaccatctatgggtctctcagctgtggataccagtgcctgttctggtggaggtggaggagggtgcaatggactccataggggttcctagctttggtggtttaatgctctatttttgtgctggttggcctcctgcatcagctatactagtgtggagagggactagaggtgggtgggccctagaactccaaagattatatgctctttgtcttctgctaccagggtgggtagggaaggaccatcagttgggggtgggactaggcgtgtctgagctcagactttccttgggcacgtcttactgaagcttctgtatggtgtgggggtgaagttcccaggtcactggagttgtgtacctaggaggattatggctgcctctgctgagtcatctgagttgtcggggaagtggagggaagctgtcagtcacaggcctcacccagcacccatgcaaactgaagggctggtcttactcccaccatgcccccaaccccgcaacagctccaagtctgtttccaggtggggggaaagtcaggcttgaaaacttgcctgaggctttccacctcccagctgtgaaagaaaagggctttagtccttcccccacctgtgaagtctgcaaaccagattcatgccctcccccaagttctggccaggaggcttctccccctgttcaaattgttagaaagttcaggtagagcagtcctccatgtggagttttaccctctgttcctttggccacacttctgatggatctctgtggtgccaggcaggaatgagctgcttggggatccagcaagctctgaggtcttctctgctgcttcctctacccctatattttgcttggctcagctctctaaatttactgaggcccaggtaaagttgggaacttctcctgcaaacagactttcagcttctccagttgtggggtgtgtttgagggagtaaggcctcccttttccacttctgcagttggggaactcacagtatttggggtgtctcccttatcctgcaggagcagtctgcttccttcacacggtctgtgggtcctctcaggattgctggtctgttcttgcagtcaatatggggctaaaattcacaatatgagcctctgcatgctgctctgtccagagctgcaatctagtcctgcctcctgtctgccacgatccctcacctcttgggtttttcttctattactttaaagatgttactttattgtttctgactttcattgtttctgatgagaaggcatcagtcatttgtgtaactgttcctttatataaacaatcttttttcctctggcttataaaattttcctagctttctttgattttagacaatttaaccaagaagatttgccaaagtaaatcatacatttttacttttcaaaatcatatttctgattgattagttttcttgaatctgtgagcttttttttcttcatatttggaaagttttcagccatcattgcttcaggcattttttctgttcaagtatctctttcttctcttgtgatatctgatcacaagatcaaatgatcatatgtatattttaaatgtttttgctaattctatcatttctgtcatttctgggtctatttgtattgaatgatttttctcctggttatggatcacactaaatgcttcttgtatgtctagtaaatttttaaatttatgtcacatattgtggatgccagataactgagcaatttgattttattgtttacctatgaagaggttaagctttcttctgatgggcaactaatttatgttgagaggattttggtctttctgacttgcttttcaattttgctaggatttttgtggagtagattttgctcttaaaatacatcaactctgtttccaaagagtggcttttctggggtctctactgaatgcccaagatttgcaatgaggtctcttttctagctggtaagaactcaaatatcccccagtgctttgtgagctctgccatctccattgaactcattgttcccttgtagttattctttccccagtagctgttctttgtcctactttcattgtggaatcactccctgtgcatatgcagatttatattacactgaggtgacttctaggtacatgactgtagctctttatctccacaaattctttctcattattaccaagtgtagaaaatcccagctgcctttgtaatcccaaactctggtgtctctcagttcatcaagactgctgtggtcttcttgggctccatctctttttccttcaatccatgatgaaatacagcacacttatggggttgatcacatttgttttctgttctaaattatctcaatacactactatctgttgtgcaacttgtgaaaacagtattttcatatattttatagtcatttacttccaaaaggctgttatgcttatacctgctttttgtccatgtacttgtccattttacttttcagcgtttgtgtacctcctgactctcatccgccttcctgcttttgctcttcaagtcctggcaacacatgtcctttcagaccactggtgcttcaggcccagtgtgtttatacctgtatgtatgtgtgtgtgtgtgtgtgtgtatatatatatatatatatatatatacatatatatatatatatatatatgtatatatatatatatatatatatatgggtatatatatatatacacacatgcacacatatatttgtgtgtgtaaatgaatattcagttacatacctgaatatttatatataaatatttaaaatgttatattaaaatatataaaaatactcagacatacatagtgaaacaatataatttttaatgaaatattaaaaatatataaatttatgcaaaaatttaaatataagttttatacacaagtatataaatattcagacatatatataaatattcagatgtttgtgtgtgtgtgtgtgtgtgtatatatatatatatatatatatatatacacatcttaatttttttttttttacttattacccatgacaaaaatggcaaacaaaccttcgggaattgaaatttagaatgacagaattgcacgagtgaaagatgacattgatttttagtgggcattgtggaatggtgctgtgtttaagctttggtcatttatcttctgagctttacattaatatgacttcgccacttccgtatattctactccttccataaaactattaggaaaaatagcaggcctaaaatttctcttctcttagactctttgctcaaaagcaaaggtcctgagacattttgccaaaatgtgagtctaagagaaatttgtccctaggaagtgagcttaaagcatgggtcttctaaccaatatttgagttggctgttgctcctcttatggttttaatcaaatacatacgcatttgggtagttttctggggtcctctgatgccagtgtggtatcatagatgaccaagattgacaggtccttcctgtgacagtggtggaggatatgcctcgataactccgtccatcaccatggtagcaatcctggaccacagggcttttctcaggtggtgctgaaattaaaataaaataaatcatactcagtaattgcatgagcagagaaacatgggagacaatttatgtcacatactggacagtagcctctgaaaattattactattcttttttctactagtagcaaaaggatgtgaaaagacccagtagattcatagtattctagaattttaataagttcatagaaacattatttttaaatctaaagataaagaacagaggagaatgctggacattggaaattacattcatgtgcagctccatcatatgaatctctgctggttttcatgagaaccacagggcagaagaccagaatgcaatgcattccttggtgcaggctgtaggaggtgactggtggtcagtcaggggccgacacaagacccttgcgcatttccctagaccattgctcataccaaggcaaaaggcttaatcttttgaaaatttgggcaggaaatcatcctacatttaggagtgcaggcaaagactcattgtttctcaaggagggttagagacaaacaacttattcccttggaggagagatagggaatcttctagtgcccagagtcctgaattgtaacaaagcagaattctcttcctcttcttctgtagactcactgccaatgcaggtttcatgagaagaagaggcaagaacacctagaaatttctaacttcaaagctgaggtgaacagagcctgtgaaagactgagataggccagggagagacagcattcgttggttacctcctgctatgcagccccaggacaatagaaaaataatgcagtctccttaggtttctctaggatatcatactcaaaggccatgttcttaagaaactgcaaactgtagattgcaatgaaaaaagtctactttaaatcactggaaaggcttattggcttggaaatcttcacatatttggcaggctgttagaatatccattttggctaggacactgaaatgacccatttaataaccaggggagtggtaagtccagtgccctggcgggtctgtgcccttcctaaagacaccgtgcccttcctaaagacactgcctcctcacagcgtgccaaaaatcacagttctggatcccccagagagggcgctgaggctttcctccacattgcagaccctcaaccaaccctccagtgtaccactgaaggcttctgcatcagtaagattttccatggtttttcatcccagtatatagatgtctaaccacaaatttcttaccttgttcagaaggagcctctgtgcttggaaccggggccactgtgggagttgtgaggacactcgattctgtcactggacatcgtgtcaggttgcagtactcccacctgacactgggatccatggtgtaacaccaagggcgaatctcagcatctggattcctgcagtagttcctggtcaggccactgcaaatttcaaaacaacacaggtcaccagagatgggagaatattcaagggcacttagcgccctctacattttgctgtaacaaagtgttaacaagtgcctttgaaatattcccattataccacaataatattgccacaagcacaaatggtcttcagcttcaacttttaaacaactgtggacacatcacagattataatttttgttttaaaacatcaaaagtagtatatgctctctatgaaaactgagataatacatgtctgtacaagaaaggatcagaatatcttcctttcaccttctgccaaatactttcctccagaataaatgacacagattttgaaatatgtatcttagattttttaatgcacatacaaagatatctctgtctgtctagctctttgtctctctctctataagactatatagtaatatgtaagttggaactcaaatacatttccccaaggaagaagtggcatccaagattatataattcccatgccagcccccttactctatttactcatagtgtagcataaatgctctacatttgcaatataaaataatcatgaaaatagtattactataaatactgtatctggtagagcaagtgggtttgggtctacaggacttataaaagcttccctggaaaactagctcccaggcaggatgctgcttctctaggatgggttcatgggcacgacctcctctcctgctctcagtccatcctctgctggctgcagccactctgggactgaaggaatgggtgatgagttgaaagaacagcgggacccaaggcataaagggagacggctaggtagactatgggatctgaaggggtcaagtggctatggatgagtcagaaaacaatgcagtaagaggcacagcaggtgaagaccccaggctggaggaatcttggagaatgccttccccattatgcctcccaagaacgttgctccaacctctcagaatcctcacattcatgacctgtggctgtctgagaaaacttggaacgtattatggagcatgggaatccaacacggtctctgtagagactctacacatgtgacctagtctcaagcccagatcccccatttgaggatgttaggcagtggtttttaacacaactggacgtatcaagtgatgtagcacctgaaacagatacctgctctgtttttcagttgagtatattttcacatagagtgagatgcacagatcttaaatgtagctggatgagatttgataaatacatatacttgtgtagcccacactgccctcacaatgcagaacattttcaccaccccagaaactcccttgtgtggctgctcaatcaatctctgctaccctcttcccacggccagtgtcaaatgctattggtttctttcaccataaattgtgttttctataaactcacatgaatggactcatacagactatacactttgacgtctggcttctttccttaatatatttttgaggtttgttcatgcttctgagactatcagtaacttgttccttgttgatgaatagtattcctttgtataaatatactggaaattcttttttcattttcttttgatgaaaccatttaaatagttttcattttcttttgatgaaaacattgaaatagtttttattttgagtttataaaacataaagctgctatgaatatttatatagatttttgtggacttatgttttcattttggggggtaaatattcaagaatagaattacaggtttgtaggatagatgcatatttatcgaactttataagaaagcatcagactgattttttaatttgttgtatgattttgaacttccaccagcatatgagagagtggcacattctagctccaaatcggtgacaccacttattattgtgtcttcttaatgatatccatgtacactggatgttcagtgtcatcttatgagggttataactcttgatttttgatggctaagatgttgtgcactttttcaggtgattgttggctctgtgtgcatcttctcctaagaaatgactattcaagcctgttgcccattttgattaggttgtttgtcctctgattagtgagtgggagaaatgtttctatactctggatacaggccatttgtcagatatatggatgagagtgtttttcttccagtgtgttacttacttatttattttcttaacagtcatatttggtgagcataagtttttattcaatgaatgtccacattatcatttgttttcttttacagttagtgttttctggttcttccctcaaaaaatttttccttctccaaggttataagatactatactttttcatagcagtcttatatttcagcctcagaattagctgttacattgaggtctaagagctatctcaaattaatttaatttgagtcatacagtaggattcaagcgtcacatttgttatagtttttttctatggctatccagttgtttcagaccaattttggaaaaaaatttcctcattaaattgctttgctacctgtattgaaaataaattgaccatatatgtaaatttatgctgacccttttctgtttttgtttgcatatgttttgcccaatactatgtattttttgtttgtttgtttgagagagagagggaaggttttaatctgtctcccaggctaaagttcagtagcacaatcatggctcatttcagcctccacctcatgggctccagtgatcctcccacctcagcttcctgaatagctgggactacaggcacatggcaccaaacctggctaatttttttaaatatttgtagagatgagggtcttgctatgttgcccaggcttgtctgcaactcctcatctcaggcaatcctctcatcttggcctcccaaagtgttaggattacagccaagcgtcccagccaataccacatgtcttgattactgtgtctttatgagaatttccatattaccatatgcatctatcccacaaacttgtgattttattccaagttttttattctttttaaagattgtcttggtgattctagcatatacattctgttaggttttcaagaaaagactgcaggaattctgcttgggtgtgggttgaaactaaagatcagttttgtgaaaagtgacattggattttttaatctataagcatgatgtgtctttatttagatcttctaattttcttctcaccaatgttatgtagtatacatggtatagttcttttgcatattgtgttaaatttatcaataaagtttttttgttttgatagtattttgtggttttgatgccaattcccatatggtattatttttcttctacttacatagcattctttcacatcttttattacataatcctgctgatgaaacattcttttatttgttctttgtttttaggaggacagaatatgtacttacgtaacattcattttcagtggaattgtttgctgtgcatagcgtttaagcttgctgggtttttttccttcttttcactctaaaggtgttattccattgtttctgacttgatctttttttttcttcttagcatattattccattttttctgacctgatcttttcttcttcttactactctaaaggtgttatttcattgtttctgattttatcttgttttccttcttaccactctgaaggcgttattctgttgttcctgatttgatctttttttctttcttacactctaaaggtgttattccattgtttctgatttgatcttgttttcctccttaccactctaaacgtgttattttgttgtttctgatttgatctttttttcttcttaccactctaaaggtgttattctattgtttctgatttgtgttgtttctgatgagaaggcatcagtcatttgtgtcactgttactctatgtaaaggtatgttttttcccttgggcttcaaataagattttactttctatctttgattatggacaatttaattatgatgtgtccaaataaatcatacagctttactttttaaaatcctatatctgatccattgagcttcttgactatgtgagtttatcattttttccatatttagaaagtcatcagccatcactgcttcaagtattttttctgttccaatatctctttcccttcctctgtgacttgctttaaacaaatattaaatattttgatattttcatagatgtccttgaggctctgtttatcttctcaggctttgtataagcgtgctatggtttgcaccaccctaatattttctagttagctttatcatctgtactatctaatatgattataaggccatgtagtgattttctcattaaagagatgtcttttttttcagttcttgactctccatttggtccttttacaatttttctttctgttgatattatccatttatttatttcttgtccacgctttctttaaatccttgaacacaattatgatacatacattttaaatctccttgccaattctgttatttttatcatttttgggtctatttgtattgactgatttttctcctggttatgggtcacactaaatgctttttgtatgtttagcaaatttttaaatgtatgccacacattgtgcatactatataattgagcaatttaattttgttgtttacctctgaagaggttgttttcttctgacaggcaattaatttacttggagatcatttggatctttttagacttggtttctaagcttttctagggtgtttctggagtagactttattctaggaatgcattaattctactcctgaagtatggttttttggggtctttgctgaatgcccaagatgttcaatgaagtgtctctcctcaggctggtcagagctcaaatacctcccagtgctatgtgagctctggcatcttcattgagctcactgttccccagcagttgttctttccccagtagctgttctttgttctcctttctctctggaaactctttctgtgcatacacagctttctgttcagccagagacttgaagagacttctgtgtgtattcctggagctccttttctccacaaatactttctcattattacctaacctagaaaatctcggttttattagtaaacaaaactccagtctctctccccagtttagcaagactgctgtggaatgctttggttaaaactctttgcccttaagtctaggaagggtaattatggggttgatcttatttgtttccctttctaaactatctcaggttgtactgtctgctgttcaacatgtgcaaacagtttttccatattattcatactcacttatggcaagaggccagtttttgtcagacatgcatttttttgtccatgtacctgcccattttaatcaccacatctgtttacttcctgactctcatctgcattcctgcttttactctgcctgacaacccatatcccttcagaaaactggtgcttagaacccagtgtgttcatacaggctagtactcatatataaatatatgcactcatttctattttcttcttcttcttcttcttcttcttcttcttcttcttcttcttcttcttcttcttcttcttcttcttcctcctcctcctcctcctcctcttcctcttcctcttcttcttcttcttcttcttcctcttcttcttcttcctcttcttcttttcttcttcttcttctttttttttttttttgagattgagtcttgctctgtcacccaggctggagtgcagtggcatgttctcggctcacagcaaactctgaatcccaggctcaagtgtttctcctgcctcagcctcccaagtagttggaattacaggtacccaccaccatgaccggctaattttttaatttttcgtagagatggggttttgccatgttagccaggctggtcttgaactcctgacctctggtgatctgcccgtcttgtcctcccaaagtgttgggatcacaggcctgagccactgcacccagcctgaatttgttacttctgattcgtgtcaaaaatggcaaacacaaatttcacttcagggaatggaggatagaatgatagaattgcatggttgaaagactgcatggacctttagtgggcattgtggaatgatactttgtctcagcatttggtcatttgatctccttagctttacattaatgagacttcaccacctccatatatcctgctgcttccatcaaattgttatgaaagatagcaatcctaaaacttctcttcattcagaccttttgctcaaaagtaagtttcctgagacattttgctacaaactctgagtctatgagaaatttggacctaggaagtgagcttgtagcatgggccagctaagagaaattttagttgactattgttccttttatggctaacatgatagacatacgcatttggatagtataatgggatcctccgatgccaatgtggtgtcatagacgaccaagactgacatgttcttcctgtgatagtggtggagagtgtgcctcgataactctgtccatcacctcggtagcagtcctggaccccagtgctgttttcagttggtgctgaaattaaaagagaaaatcaagctcagtattgcctagaaaagggaaatgtgaaaaaaattatgacacacaaagtggaataatctgaggattaacaatttacactcttctatattagcatgcaaattgaaatgtagaataaaaatacaaatagacttataggattctagaaatttaataagtagtcataaatattttaattcaaccctggaaaacaaacaaacaaagaaacaaacaaaaaacagatcagagtgcctatacttcaaaattacactcatgtgaatggtcttttgcttacacctcttctgggtgttcatgagaacaaggcaggagaccagggtgccatgcatcaagctgttcaggctataggtggtgattggctgttagtggggggtatacatgaaacccttgcacactagaccactgctcctccaaagcaaaagccttcagattctggggtgtggggcagaaaaggatcttgcatctaggacttgtaggtaaagacacattgcctctcagggagaaggagtacaggccaaaattttatagcctaggaggggagacagggaatcttgggcccaggatccctcattacaagaaagctgacatccactactcttcttctcaaaaaacaacggagataaatgttccatgagaagcagggatgagaacactgagaaatcccttccctcaaatcctaggtgtggaaggcatgcccaagatgaaggtaggctggggagataaacaatttggtggctatgtactgcttcaaagtctcaggacaatacggatctaatgaagacatgttaggtttctcaagaacaacagcctcaaaaatggcattccttcaaaatggtaaagctgaagactgcaataaacactgcctacttgaagaaagggctggacaggcttaggagcttggtatatcttcacaagtttggcaggatgttagaatatccatcttggctaggacactaatatgattcgtttgataacagggaagtgataaatccagtgtcctagagggtctgtgccccttttaaagacaccatccctcacaaggcactcaacatcccagctctggtccccccagagaaggcactgaagcttccttcccattggctgtccatgacttcaccttcgacttcctgtgcagcatggaagttttctgcatcacaaagattttgcaaatctttttatcccaatgtccgagggtatggttgtctgactgcaggcttcttaccttcttcagaaggaagctctgtgcttggaactgggaccaccgtgggagttgtgaggagagttgattccatcactggacattgcgtcaggttgcagtactcccatctgacactgggatccatggtataacaccaagggcgaatctcagcatctggattcctgcagtagttcctggtcaggccactgcaaattccaaaacaatacaggtcaccagagattggagaagatacagcaccacctggcaccctctatgttttcttgtaacaaagtgtaaacaagcaaatttgaaatattctcactaaagtcccataacactcacaaatggtcctcaacttctaaacaactgtcaacatttcaaagacagcttatgattcttattgtaacacattcaaagtaatctatgctttataagaaaactgagagaaaacatcaatgtgtaccagaaaggatcagaataccctccttctaccttctgccaaatacattcctttggattaaccgagagggattttgaagtgtgtcttggagattgtttcacgtacatacaaatgtttatctgtcaggctgtctgtaagtctctataaaactgcatgatctattcagtgtttgatttgctgatttgttatttacctaagcaatccatccacatgatctacattcatgaatttatttacatacagttgatctcaatatctacttctcagctttcacacctggaggatgctatagcaatggcatctctctcctgttactcatgatggtgatggatatgctccctccttggtctgtcatctgtttagccagactttggccaatcatatagacttttcaaagaacctaactttctgtttcatggatttactcctttgttggtctattttcttttccactgaatgtcattggtttggactatttccttccatcctctttccttgtgccttatttgcttttccttgcctagatatttaagctgtggtcttagatcaacagctgtcaaagctgttgttcataggaaccccctttttttctttttagctttgaattgaggcaacttaactatgatatatcccagtaaatcatagagttttgctctttaaaattctatacctgagtcatttagcttcttgactatgagtttcttgttttctgtatatttggcgtgttgcgagccatcatcgcttcaagtataatgtctgtcatgatatctttttcttctccttctgtgacttgcctaacacatatattaaatgtgtggatttttcctagatgcccttgaggctctgttgattaataggttcagtctttgtgtgtgtgtgtgtgtgtgtgtgtgtgtgtgtgtgtgtgtgtgtgtgtttctgtctgttggtctgtctgtctgtcctgtgatttgtgtagctcctattgaattattttctaggtcacctttcctaccgtaatgtctaaagtgatgataaggccatccagtgagttcttcattagagatgtaccttttctcagttctttaattttcatttggctctccggttcttttcttttctcttgctattctgcttttgtttctctcatggtcagcttttgctgacattttcctgaaacacagttctcagaggtgcattttaaatgttctcaccaatgtcatcaattctataatttctgggcctgtttgtgttgagtgattttttctcccagttatgtatcacagtgaaagcttcttgtgtctctattaaatttttaaatagaagtaacgcaataggaatgccatataactgagcaacttgtatttgtcccttgcctctaaggggggttgagttttttttttcttgtggaatgcagttaatttacttggagatcatttggatccttttagactggcttggaagaagggttgttggagtttttctggagtcaccttgattctaggaataagatgatcccaatcccaaaatacagctttctttggtctctactgaatgcccaaaatgtagtgaggtgtttctcctctgagtggtcagaattcaaatatcccccagtgctatgtgagctctggcatctccattgagcttactgttcccctgcagttgttctttcccaagtagcttttctttgttgttctttctttatgaaaactctccctgtgcatacgcagctttgtatttagccaaagccttgaggagacttctgtgtgtattcctggagctcctttcttccacaaatcccttctcattcttagccagcctagaacacatcagctgcctgaggcatcgcagactccagtctctctcctcagttaagcaagactgctgtggtcagctgggctccatctgcttgtccttcaatccaacactgtgtccaggaaggaagacaggttaatgatgaagttgatctcctttgattccctttctcagttctctcaagcctaccatatctgttgtccaacctgtgaaaactgttttctcatgtatttgatagtccttcatggcagaaaggctggcatagccagacatgggtttctgtccatcttcctgaatgtgtaactcttcagcatctctatacttcctgactctcagctgccttcctccttttgcccctcatgggctggcaacacatagcttttcagacaccttgttctcagaacccaatgtgtttatacaggttagaggagaaagtgatcggaagatctcgaagtcaatatagatatccttcacttgttacccaagacaaacatggcaaacacaaccttcactccagggcttggagattagaatgacagaattccctggttgaactatttcactggtctttagtgggcattgtggaatggtgctatttctaagcacatggtcatatgttcttctgagctttctattcatgagacctcaccacctccaagtatcctcctacttctatcaactatgagaaaagagagctggcctgacatttctctcctctcagaccctgtgcccaaagcaagaagcctgagacattctgtccaacattctgggtctgagagaaattgggtcataagaagttagctggaagcatggctcttccaggagaaatttaagtgggtggctgtttctcttgggagaaaactcaaagacatacccatttgggtagtattctgtggttctctgatgccagtgtggtgtcatagaggaccaagactgacatgtccttcctgtaacagtggtggagaatgagcctcgataactctgtccatcaccatggtagcagtcctggactgtggggctttgctccgttggtgctgaaattcaaagaggagaaaacaaactgagtaatttccagaacacagaagcatgagaaaaaaaatccatgatagaaacaggacatcatctctgaaaatgacgaccatgctctgttctacattagtaggcagatggacatgccaataacaaagctcaaagattcatagcattctggaacttcaatgagtttttagaaagattttctttaaaacctgggcaccaaaggacagatcagagtgcctatcagtcaaaattgcactcatgtgcctgttctttggcaaagatctcttttgggtgttcctgagaacaaggcaggagaccagagtgccatgcatcaggcggtgcaggctgtaggtggtggttgtcagtgggggcagacatgaaaccgtcacacatttctccagagcactgatcctccaaagccaaagccttaagtttctggaagatggggcaggaagtggtcctccatctaggacttccaggcaaagacacattgtctctcagagaggggtactggccaaaattttattcccttggagggacggcgggaaatcttgggcccaggatcctgcattgcaacaaagtagacatccactactcttcttcacaaacagcaacacagatacgtgttccatgagaaggaggggcaagaacactaagaaatcccttccatcaaagcctaggtgtgcagcacctgcctaagattaaggtagacagggagatagagcatttgctggctatgtactgttacctagacccaggaggatatggaactaagtaaagtcatatcaggtttctcaaggatgacagactcaaaaaccacattcctctgaaactgtaaagctgaagtttgcaatgagtactgtctacttgaagaaataccaggaaaggctcatgatgagcttggtaaatcatcacaaatttggcaggatgttagaatatccattttcactaggacactgaaataatctattgaataaccaggggagtggtaaatccagtgccctagaaggtctgcacgcttcctaaagacaccaccctgtcacggggtgccaaaaatctcagccctggttcccccagagaaggcgctgaggcttccttcccattggctgaccctgagtccacattcagattcccgtgcagcatggaaggcttctgtatcactaagattttgcaactctttttatcccaacgtccaagggtgtggttgtctggccagagacttcttaccttgttcagaaacagccgtggacgtcgcaaggacacttgattctgtcactggacattgtgtcaggttgcagtactcccatctgacattgggatccatggtataacaccaaggactaatctcagcatctggattcctgcagtagttcctggtcaggccactgcaaattacaaaacaatacagttcaccagagatgggagaagatacaagggcaccagacatcctctacattttgttgtaacaaagtggtaaaaagtgactttgaaatattctcactaaaggtcctgtaacaatcacaaatcgtcctcaacttctaaacaactgtgaacatttcaaagacagattatcattcttattgtaacacatccaaactcgtctatactccataagaaaaccgagagaaaacatcaatgtgtacaagaaaggatcagaataccctccttccaccttctgccaaatatgttactttggattaactgagagattttgaagtgagtcttgtagattgttttatgcacgtacaaatgtttctctgtctggctatctgtatgtctttctataggagtacccaatctattcagtatctggtttgctgatttgttgtttacctaaggaattgatccacatgatctacattcatgaatttattcacatacagtttttcttgatatcttcttgtcagctttcagacctggagtatggtatagcaatggctcctctcccctgttacttcaaatggtgatggttgtactccctccttggtctgtcatctgttcagccagactgtggtcaatcacatgaatcttttcaaagaaccaactttctgtttcatggatttactcctttgttggtctattttcttgttcactgaatgtcattggtttggactatttccatccatcccctttccttgtgtcttatttgcttttccttgcctagatatttaagctgtggtcttagatcaactgtcaaaatgtttgttcataggaaccccctttttttcttcttagctttgaaatcagacaatttaactatgatgtaccccagtaaatcagagttttgctctttaaaaatctatacctgagtcattgagcttcatgactatgaatttctcattttctgtatgtttggaaatttgtcagccgtcatggcttcaagtataacttctgtcacattatctttttcctctctttctgtgacttgcctaacacatatattaaatgtgtggatgttttcctagatgtccttgaggctctgttgattaattggttcagtcattgtgtgtatgtgtatttgtgtctgtctgtctgtcttgtggtttgtctagctttaattgaatcattttctcgttcaccttttcctaccataatatctaaactggttataaggccatccagtgaattcctcattacagatataacttttctcagtttttaaatttccatttggctcttcaattcttttcttttctgatattatgcattcatttctctcatggtcagcttttgctgacattttcctgaaacacagttctcagaggtgcattttaaatgttcttgccaatgccataatttctattatttctgggcctatttgtgttgagtgatttttctcccagttatggatcacagtgaaaacttcttttgtgtctagtaaatttttaaatgcaagttgcactctggggatgtcatataactgagaaacttgtattcgttccttacctctaaggagggttgagtttacttttttctggaaggcagttaatttacttggaaatcatttggatccttttagactggcttggaagaagggttgctggagtgtttctggagtcaccttatttctaggaatccgaagatcctactcccaaattatggctttctttgacctctactgaatgcccaagatgttcagtgaggtgtctctcctctgagtggtcagaactcaaatatcccccagtgctatgtgagctctagcatctccattgagctcactgttcccttgcagttgttctttccccagtagcttttctttattgttctttctttgtgaaaactctccttgtgcatacgcagctttgtatttagccaaagccttgagaagacttcggtgtgtattcttggagctcctttcctccacaaatcccctctcattcttagccagcctagaatacgtcagatgcctgaggcatcacaaactccagtctctctcctcagttaagcaagactgctgtggtcagctgggctccatctgcttgcccttcaagggtctcaaggaaggatgccagggacatgataaggttgatctcctttgattccctttctgaattttctcaggcctgtcatgtctgttgtccaacctatgaaaacacttttcctatgtatttgatagtccttcatggcagaaacgctgacgtggtctgaactgggtttctgtccatcttcctgcatgtgtaactcttcagaatctttatacttcctgactctcagctgccttcctacttttgcccctcatgtgctggcaacacatagctcttcagataccttgttctcagaacccaggtacaggttagaggagaaagtgattggaagatctggatgtcaacatagatatcctttatttgttgcccaagatgaacatggctaatacaaccttcacttcaggacttggagattagaatgacagaaatccctggttgaactattgcattggtctttagtgggcattgtggaatggtgctatttctaagcacgtggccatgtgtcctgagctttctattcatgagaactcaccaccttcaaatatcctcctgcttctgtcaactatgagaaaagagagctggcctgacatttctctcctttcagacactgtgcctgaagaaagaagcctgagacattctacccaacattccagatctgagataaatttgtcataagaagttagttggaagcatggcccttccaagagaaatgtaagggggctgctgtctgtctttgaagaaaactcaaggttgtacccatttggataatattctgttgtcctctgatgccagtgtggtgtcatagaggaccaagactgacatgtccttcctgtgacagtggtagagaatgagcctcgataactctgtccatcaccatggtagcaatcctggaccccggggctttgctccgttggtgctgaaattcaaagaggagaaatcaagctgagtaatttctagaacacagaagcatcagaagaaatctgtgactgaaacaggatcattgtctctgagaaagactaccatgctctgttctgtactagcaggcagatggacataccaataataaaacccaaagattcatagcattctagaactttaacgagttcttagaaagatttcctttaaaacacaggcaccaaaggaaagatcagagtgcctatcagtcaaaattgcactcatgtgcatgctctttaatatagacatcttctgggtgttcctgagaataaggcaggaaactagactgctatgcatcaggctgtgcaggttgtaggtggtgattgactgtcagtggggacagacatgaaaccgtcacacatttccctagactgctgatcctccaaagccaaagccttcagcttcttgaagatggggcaggaagcggtcctgcatctaggactcgtaggcaaagacaaattgtctctcagagagggctactggccaaaattttattcccttggagggatggctggtatctttggcccaggattctgcattgcaacaaagtagatatccactactcttcttctcagagaccaacacagatatatgttccatgagaaggaggggcaagaacactgagagatccctcccatcaaagcctagttgtgcaggactggcttaagatggagataggccagaacgatggagcatttgttggctatgtactgctacctggacccagaagtatatggaactaagaaaagtcatattaggtttctcaaggatgacagactcaaaaaccgcattcctccgaaaccgcaaagccaaagatgcaatgaacactgactacttgaagaaataccatgaaaggcttatcatgagcttggtaaatcttcacaaatttggcaaaatgttagaatattcttctggctaagacactaaaatgatcctttgaataaccaggggagtggtaagtccagtgccctagagggtctgcacccttcctatagataccaccctttcacagggtaccaaacatcacagctctggttctcccagagaaggcgctgagtgttccttcccagtggctgaccctgagtccacattctacttggaattgtgtgagcatggaaggcttctatatcactaagattttgcaactcttttcatcccaacgtcctagggtgtggttgtctggccatagacttcctaccttcttcagaagaagcctctgtgcttggatctgggaccaccgtgagagttgcaaggacacttgattctgtcaccaggcattgtgtcaggttgcagtactcccacctgacactgggatccatggtgtaacaccaagggcgaatctcagcatctggattcctgcagtagttcctggtcaggccactgcaaatttcaaaacaacacaggtcaccagagatgggagaagattcaagggcacttagcgccctctacattttgctgtaacaaagtgtaaaaagagactttgaaatattttcactaaaggtcccataatatgcacaaatggtcctcaacttctaaacaactgcgaacatctcaaagacaaattatcattcatattgtaacacatccaaagtcatctgtgctccataagaaaattgagagtaaacatcaatgtttactctgtacattgtgcaagttgcacttgtacttgtacaacttcaattgtacttgtacaattatactctgtacattgtacaatgttgtacaatgtacaagaggatcagaataccctccttccaccttctgtgaaatatgttcctccagattaactgagattgattttgaagtgtgtcttgtagattgttttatgcacatacaaatatttctctgtcagcctctctgtatgtctctctacaggactacactaactattcagcatctggtttgctgatttgttgtcttcctcaggaattggcccacatgattaacattcctgaatttattcacatacaattgttctcaaaatcttcttttcagctttcagaactggaagatgctatagtaatggcacctctcctctgttactccagatggtgatggttgtgcaccctcattggtctgtcatttgtttagccagactgtgttcaatcatatggatcttttcaaagaatcaactttctgtttcaagagtttactcccttgttggtctcttttcttgttcactgaatgtcactggtttggactacttccttccatctgctttccttggctcttatttgctttttttttttttcttgtgtagatatttaagctgtggtcttagatcaacaactgtcaaagtctttgttcataggggattccaaagagcttttctttttcaaaacacaagatgaatatttatagtataagaaaccaacactgagaatttttttaacacacaaagtcaacaattgcccattttcttagccatcagagacatgatgccattacatattatgtaactgctggaaaactcccctcttctcttgttggaaaatgaaagtaaaaagggccaatagcatcttacttttcacgtagcaaagtcctttaacctcatggactgtctctgaaggtactcaaaggtcctcaggtttctctagactacactttgagaattgcagtttgaaatcttgattattacatgcttctgtttttccctaagagcatctaaaattatgtaaaagcctaaagacattcactgcatctcctaagtttggataaattgtgttatattcttactcagttcaaaacttttctaaattccttagtgatgttttctttgtcccaaagagtattttgaaatgcaccgtatgactcccaaatatttgagaagctggcaaacttctcattattcatatctcactttattctgggagaataaagtgacacactctgtatgactttaattcttttaaatctatggagacttgctggaaggtcatgtgtagagtacacctcagtgaatgctccatgcacactttaatgtgtactcggtagttcggtataatgttaaataggtcgacgtttttattgagaacaaagatactatgtctaattttctgcatatttgttctagcctgttgtgtttgggaaagatttataaccatagtgagagaatcaaggaaatctctaactcagagtgtgggcttatctatttctctcttcagttgtgtcagtttttcaatcatacatcacaaaagctcttattagggtaaaacacattgagcattgctacatattcctcaatgaacaatttttacttctctatgtttcaatgctcgtgtggctctaggattcacacctgtgtgggtgtgggtgtgtgcacgtgtgccattgtgtgtatatatgtgcagctatttctgtagattctattgaattatttttcagttaattttttccctggaaacaactaacctgattgggagaccatccagtgaatttttcatttaagatataccttttaatagtcctttaatttgatttgactcttttatccttttactttcccttgatatgatatctgttacgttccatgtttatgttttcttaaatccagcaatgcagttatgatactaatatgtcaaattctcatgccatttaaatcatttctatcattcctggttctatttttattgactgattattttcctggttatggttcacactaaatgcttttttatgtgtagtaaagttataaatttaggactcacactgtggatattgcatagctcagcaacttaactttgttgttcacctgtaaagagtgttgagttttcttctagaaggcagttaattgactaggacaccattttaatgcttggagatttgcttttcagctttgctaggttttttctggagctgcctttattctaggaatatacaaagtctactcataaagtctgacttttctgaggtctctactgaatgcccaagattttcaatgaggtctcttctctctagctggtcaaaactccaatattccagagcactatgtgagctctgtcacctttattaagctcactgttcccttgtagttgttgttcctcaatatatggtgtttttttgccatattttcttgtggaaaatcttctatgcaagtgctgctttatgtttagactaacacttgaggagacttctatgcctggagctcctatcctccacaagtccattcttactcttagcatggctagaaaatcctaactacctgagtaatcccaaagtccaatcactctcctctgttcagcaacatggctacagtcagcttgggctccatctccttgctcttcagtgcaggaagggtctccttgaagaaagccaaggcattgatgggttgatctcattttctccctcttgcaatactcttggtcctctagcatctgttgttcaacatgtggaaaccgttttgccgtgtctttggtagtcacttatggccgaaagactggccatagaatggccagatcatggcttctgtccatctacccgccccttttacttttcagcatcgcccctttgctgactctcatctgctttcctgcctttgttcttctcctctgggcagaccgtatctcttcagaccactggtgctcaggaccaagtgtgtttgtacccattgaaaaagaagtagatagaaaaagatttgcctctccatagatgtgcaagtatcaattccctgtgacccaagatgcaaaaggccaacacaacattcacttcagggactagagcttagaatgatagaattccaaggtgaaaaggttgtattaaccctcagccgatgttgtagaaggatactctaactctttggtcatttgtcatcccggctgttttattaataagatcttctcaactccatatatccttctgcttccataaaactaggaggaaggagagccagcttaaaaaatgtcttctcagccaggcacggtggctcacgcctgtaatcccagcactttgggaggctgaggcaggcggatcacgaggtcaggagaccaagaccatcctggctagaacagtgaaaccctgtctctactaaaaatacaaaaaattagccgggtgtggtggtgggtgcctgtagtcccagctgctagagaggctgaagcaggagaatggtgtgaacccgggaggcggagcttgcagtgagccgagatcatgccactgcactccagcctgggcaacaaagcaagactctgtctcaaaaaaacaaagtcttctctaagaacttttgctcacaggaaatgttcctctgcatctgagccaagttgagtcctgagcagtcaccttgaagcatgactcttctaacagaaacttccattggcccttccttcgcttatggtaaagaacaaagacgtacgcatttgggtagttttctggggtccgactatgctggtgtggtgtcatagatgaccaagcttggcaagttcttcctgtgacagtggtggagtatgtgcctcggtaactctgtccataatggtagtagcagtcctgtaccccgggggtttcctcagtcagtgctgaaattaaaacagaagacatcaagcttattatttcctagaacagaaaaatacaggaagccatttatgacataaaccaaaaaagagtcactgagatttacaaccattctctattctttattaataggcaaatggacatgagaaaacacacaaacaaacacgaaagtaagagatgcctaccattctagaactgtagtaagttcttagaaatatttcatgtaaaacttagtggaaaagaaatatcagattgcttctcatcggaaactccactaacatggaagctcatttctaggaatctctacagagtgttcatgacgacatggaacagcatagaagaaagggtgatgcatttggcaaagctgaaaagcaagtctccaagcattaaaatggttttttggggaggaggcaaggacatataaaaaccttgcatgtgtccctagatgattgctcaaaaaagaaagcattaaactcctggtgatggggcagacaacagtcctgcagctaaaactgtaggcaacaacacttcacttctcagggatgagtggaggccaaaagcttatcacctacaataagatagggaatcctctcgtgcccagcataatgcattgcaataaagcaaaagtctactactctttttctccagaccccccgcaggtacaagttccatcagaaagaggcaaaagcacacgaaaaaatcactcccttcaaagctaagaactgcacaacctgcctcggactgaaaaagacctgagagatagagcttcgggagctcatgtactactccacagacccagggagatatggaattaatgcaacccagttaggtttctcaaggataacaggatctagagccacatttctcggaatctgcaatgctgaagattgcactgaatgctgtctacttgaagaaatccctggaaaagtttactggcttggaaagacacacacatctgacagcatattacaataagaattttgtctaggacaatgagatagccccttttacaatgaggggagtggtgaagtcgagcacccagaatggtttccgcccatcctaaagacacagctcgcacaggttgcaccaaaaatcacacctctggctcccccagagagtgcgctaaggcttcctcccacatggcagacccagaaccaacacacgagaaccagtgtagcactgaagggttgtgcgtcagtgggggtatccatggcttttcatcccagcatccaagcaggtaaatgtctggcacaacttcttaccttgttcaaaaaaagcctctaggcttggagccagaataacattcggagggacgaaggcagtccattctgcatctgagcatcgtgtcaggttgcagtactcccacctgacactgggatctgttgtataacaccaaggggctgccacaggatctggatttcggcagtagttcttgatcaagccactggaaattccaaaagaatacacatcacaaaaaatgggtacatatgcaggaacactgtatattttgctacaacaaggtcattactggtgcctttgaaatattcccaaaagagataccatacaattgccacaatgacaaatggctctcaatctctaatcctctctgcacatttctcatacttaatatattatcactttttttaaagaaaaaaaatctaatgcagcacacacttcctagaaacactgagattatacatacatgtggccaaaaagggatcagaatatcctccttctgccttctgcccaatccatctctctggaataactggtatggattttgacgtgtgtattgtggaattggttatgcacatacaaaagtatctctatctgtctagctctccgtatctctctgtgtaggacttcatatagtaatgtgcgagttggaactaacacatagttctccagagaaaaaaatggcatccagcatgatatccttcccaggccagcagtctcattcaatgtactcaaaatgtagccaaaaggctctatgttcagcatgtaaaaccattgcacaaaaagtattcctgtctgtcgataccgtatcaggtgggtcaagtgggtttctttctgcaagacttctcaaagctgccctggaaacctagctttcaggcaggatgcagtatctctaggatgggttcctggtcaggacttcctctcctgctctcagtccatcctctgctggccacagcaattccgggactgagggaatgggggatgagttgaaagaacagtggcactcatggcataaagggagacagctgggcagactatgaggtctgaagaggtcgggcagctatggaggacctcaggctggggaaatctcagagcattcactcctccttatgcctcctaagaacattgctccaacctctcagaatcctcccattcgtgacctgtggctgcctgggaaaacgggaaatgtattatgggccatggggatccaacactgtctctctagagactctacacatgtgacctagtctcaagcccagaccctccattccaggaagctggttcaatgagcaactggatgtgctcagagcttgagtacttgaaagacttctttttcttccttggcttccctcttttggatacatggaaaattcttattatataatatccctcagaattcaaaattttatgattgctttaggatttacaatatccctttggacccacaaattcaacctttcattaatattacataccatcgtggataaggtaagaaacttacaatggtacacttccaattattccccacatgatttagtctatatgttcaaatttttacctctacatatgctaaagttaaatatattgctatcattttgcttcaagtagtcaactctcatttaaaaagatatagaaatttgatcaagaaaatattttgcatttacatctacatttgccatttgctgggttcttcattacgtgggctgcagaaagttctcctcttgaactattcttcttctagctaattttctttgggcaacatctcttgttacacaagcctgctgattccaaattattagtttttggtttatttatttggggcagtgcacaatatgcatttatccaacatggatgatcttcaaggcattttattgctggatgtagcattctcatttgatctcttttttttctagtttatcattttaatgatatcccctgttaactgggttccagtgtttctgatgagaatgcattagcaatttgtatcactgttcttctagcaagacacagctctttttcctccagtttctcatgagatgtttcttgttattatatctttgccttctgactgttgaacggtgatgtacaaaagtgaatcatacagtttttttttttttttttttggaaattccctgtctgattcattcagcttcttgaatctgtggtttttaatattcttcttatttgaaaagtttttagctatccttgcttccagtatttgttcctgtagcaatctctccttcctctccttctgtgacttcctacccacatgcaggaaatctttttatattttcccgcctgtctgtgaggatcagtggatttcattttttagtatttgtggaggtgtgtgtgtgtgtgtgtgtgtgtgtgcgtgcatgtttctaagcctgtgcatgtgtgagtatgtgtgtatatgtgtgtgtcatttgtgtatgtgtagctggttctgtaggtggtataaaattgtttttcagttagtttttacttctgaaacatctcactccattgggaatacatccagtaattttttcatttaagacataccttcttatactagttctttaatttaatttggctcttctatactgttactgtctcttgatatggtatctgcttcattccgtattcatgttttcttaaaacctaaaactcagttgacatattgatatgtcaaattttttgccattctaatcatttctgtcatttctaggtctatttgtattgactgatttttcacctggtcatggttcatactaaaagcttctctatgtgtagtcaagttttaaatttagaactcacactgtgaacaccacatagctgagccacttgactttgttgtttacctctaaagagggttttcctctcccaggcagttaattgacttggaaatgattttaatgcttggagacttgcttttcagttttgccagggtttgtctagagctgcctttttttctagaaatttactaattctactcctaaagtatgacttttctggagtctctactgtattcccaagaggttcagtgaggtctctcctccagctggtcagaactccagtatcccagaatgctatgagggctctgtcctctttattgagctcactgttcaatcgcagttgctattcctcaggatatattcttttctctactttcttgtggaacctttttctgggcacatgcaacgtcatgtttagccaaagattcgaggagactactatgcgtgcccctggagctcctttcatccacaaatccattctcattctcagcaggcctataaaatcctagctaccacagtagtcccaaattccaatctctctcctgcattcaggaagatggctacagtccatctgggctccatcaccttgctcttcagtgcaagaagggcctccaggaagaaagccaaggtatctatggagttgatctcattgttccccctgtcactattcttttggtccactactgtctgttgtccaacatgtagaaaccatttttccatgtctttggtgtcacttatggcctaaagcctggccatgggctggtcagacctgggcttctgtccatctatccacccttttactttacaggatctctctctttgctgactctcatctgccttcctgccatttttattctctaacaaccagtatcccttcagaccactggtggtcagaaccgactgtgtttctacatattggaatagacgtagatatagaaagagatagatttgcctctccatagatatacatatatactttccttgtaagccaaaacagaaaaccccaacagaaccttcacttcaggaattggagtttagtttaatagaattccaaggagaaaaggctgcattgaaccttagtgggtgttgtggaagggtactctaagagtttcatcatttgtcatcttgacttgtttcttaatgtgatatccttgcctccagatacctttctgctccattaaactaggaggaaggagagccagattaacatttgtcttctcttagactctttgctcaaagacaatgttcctgagacattttgctatgcactgttcatctgagacaacttgagtcctgaacactcagcttgaagcatgactctactaacagaaatttccactgacccttccttcacttatggtaaagaaaatagacatacgcatttgggtagtatgctggggtccgactatgcgagtgtggtgtcatagatgaccaagcttggcaggttcttcctgtgacagtaatgaagtatgtgccttgataactctgtccatttccgtggtagcactcctgcaccccaggcctttgctcagttggtgctgaaatgaaaagaaaagaaatcaaactgagtgtttccaagaagagacaaacatgtgaagccacttatggcacaaaccagaaaaaagtctctgagaattatgacctcaggagaatatgacaagtaacattcttgtttctttatttgtaggcagatggacttgagaaaagcaacaaccaaccaacaaacaaaaacaccaaagaaacaaattcctaacactttagaactgtagtaagttcttagaaatatttcacataaaagcttagaaaaaaaggacaaatgagagggcttctcaatggaaactgtgctcacgtgcaagcacatttatgggaatttctactgaatgttcatgaggactatggggcagcaaacagcaaagcacgatgcatttgggggtacaggccatacatggtgattgggtgttaggggcagagaaacggacagacatgaaaacaatgaacgtttcataacaaaaggcaaggtcttcagcttctgggccatgggagagacaacagtccttcgtctaggactgcagacaaagacacttcagttatcagggatgggtggaggcgaacagcttactcccctgcaggagagatgaaatcctctcatgacccacatcctgagttgcaataatacagaagtctccgactctttctatccagaccgctcacaggtacaactgccaccagaacacggggcagtcactcacttaaaaacctagggctgcagagcccacctatgactgaggaagtcctgaaacatagatcattgggagttcatgtactgctccatagaaccagggtgatttggaattaatgcaaccctgttagccctgtttctcaagggtgacaggctccagagccacatttctctgaatctgcaatgctgaagattgcactgaatgctggctaattgaagaagtcccaggaaaagcttactggcttggaaagagtcacacatctgacagcatgttacaataaaaattttggctaagacactgagatagcccatttttcaacgaggtgagttgtgaagtcgatcaccctggagggtttgtgccaattctaaagacacagcccacccaacgttgtaccagaaatcaatccgctggctcccccagagagtgcacggaggcttcctcctacatgacagaactcagtcaacactcgagcatccgtttaccattggaggctgctgcatcagtgggaatttccatggcttttcatcccagcatcgaaacgtgtaggtttctggccacaggctccttaccttgttcagaaggagcctctaggcttggaatcggggtaatagttggaggcgcgacggcagtcccttctgcgtctgagcattgtgtcaggttgcagtactcccacctgacactgggatccctcgtataacaataaggggctgccacaggatctggattcctgcagtagttcatgatcaagccactggaaattccaaaacgatacacgtcacaagaggtgggacaatatgcaggggcaccccacaccctctcctttgtgctgcaacaaggtcattaccagtgcctttctaatattcccataaaagtaccatatgattgccacaagcacaaatggctctcaatcactaatcctgtctgcacatttctcatacttaaaagattattattataaaaaaaaatctaaagtagcaaacgcttcttagaaacactgagataatacatacacgtgggcaaaaaacgatcagagtattctccttctgccttctgcccaatccatctctctggaataactggtatggattttgatgtgtgtattgtggaatcgtttattcacatacaaaagtatctgtatttatctagttctccgtatctctctcggtaggacttcatattctaatgtgcaagttgcaactaacaggtagttcttcagaaaaaacatgggatccaggaggataacctttccaggtcaaccttcactctctatgtactcaaaacctcgcgaaaaggctctacttttcccatggaaaagcactgtgcaaattgtattactttctgtcattcccatatcatgtgggtcaaataggtttgtttctgcaagacttctcaaagctgccctggaaaacttgctcccaggcagaatgcagcatctctagaatgggttcctgggcaggaccttctctcctgctctcagtctaccctctgctggccgcagctactctgcactgagggaaagggggatgagttgaaagaacagtgggacccatggcataaaggaagatggcagggtagactaagagatctgaagaggtcggacagctacggaggaacactgcattagggggcaaagcaggtaggagtttgggctgcggggatcttgaagcatttgctcttccttatgcctcccaagaacgttgctccaacctctctctatcctcacattcatgacctgtggctgcctgagaaaatgggaaatgtattacgggccatggggatgaaacactgtctctctagagactctatacatgtggcctagtgtcaatcccagaccctccattccaggaagctggttcaatgagctacaggatgtactaagagcccaaactcgtgacaaatttctttcttccttggcttctctcttttgaatacatggaatattcttattatacaatatacctcagagttcaaaactttgtgattgctctaggatttgcaatatctccttgaacccacacagtaacattttattaatattacataccattgtgcatgaggtaagaaacttacaatggtacacttctaattattccctacatgatttacgctacttgttcaaattcttacctctacatatgctaaaattaaatatattgctatcattttgtttccagtagtcaacgctcatttaaaaatatatagaaatttggtcaagaaaatattttgcatttacatctacatttgccaattgctgggttcttcattacatgggctgcagaaagttcccttcttgtactattcttcttctacctaattcctttgggtcacctctcttgttacatcagcctgctgattccaaattcttacagtttccggtttctttgtttggggcagtgcacaacatacatttatgcagcatggatgatcttcaaggcattttattgctggatttagcattcttggttgatctcttcttgttcctgtttaccacattaataacattcccggtatctggcttccagtgtttttgacgagaatgcattagcaatttgtatcactgttcttctagcaagaaacagcttgtttttccccagtttctcataagaagtttcttgttattatatctttgtcttcttaccgtgaaaatgtgaagtacaaaagtgcatcataccagattttttctttttttcgaaacgcctatttgatgcattgaatttcgtgtttttgcgattttgttaatattcttgatcaatgaaaagttttcggccatccttgattccggtatttgtttctgtttccaatctcccgttctcttttctgtgacttgcttcccatatgcaggaaatcttttcctattttgcaacatgtctgtgaggttcggttggttttctatttcactatttcttgagggttgtgtgtgtgtgtgtgtgtgtgtgaacttgtgagtttttgcgtgggtgtgtatgggtgtgttgtatgtgtatatatgtgtgtagttggttctgtagaattgatttttggttagtttcctattcagaaatgtctaaattgatcaggcagccatccagtaattttttcttttaagacatagctttttacactaagtctttaatttgatttggctagtcaatactgttactttcttttgatattttatctgttttattacatattcatctttttttaaatatttgaaatagttatcttagtcatatgtcaaattttcatgcaattcttctattcttcttatacctaattctttcgggtcacctctgttgctacataagcctgctgattccaaagtcttacactttccagtttctttgttttgggcagtgcacaatatgcatttatccaacatggatgatcttcaaggcattttattgctggattcagcattctcggttgatctcttcttgttcctcattatcattttaataatattccctggtatctggcttccagtgtttctgaggtgaacgcattagcaatttgtatcactgtactctaggaagacacagctcttttttctccagtttctcgtgagatgtttcttcttcttatatccttgccttgttacctttgaactgtgatgtagagaagtgcatcatgtagttttttttctcgaaatttcctatttgatccctttagtttcatgaatctgtgatttttctaacgttcttcataattgaaaagttatcagccatccgtgattccggtatttgtatctactccaaactcccttgctctttactgtgacttgcttcccacatgcaggaaatcttcttatattttcctgcatgtctctgagggtcggttaattttatatttccctatttctttagggatgtgcatgtgtgtgtgtgtttgtgtgtgtgttagaacttgtgagtttttgcatgtgtgtgtgtatgggtgtgttttgaatgtgtgtgtgtgtggctcattctgtaggttctgcagaattgtttttggttaattttttcttctgaaacatctaaatttttcaggcggacatacagtaatttcttcatttaagacatactttttgtataatagttctttaatttgatttggctattctatactattaatttgtcttgatatgatacctgctttgttgcactttttttaaatatctgaaatcagttatcatactgatatgtcaaattttcatgcaattctaattatcgatgtcatttctgagcctgtttgtattgcctgatttattttctggtcatggatcacacgaaattcttttctacacgtagtcaaatttttaatttaggactcactctggggataccgcatagctgaggcaattgactttgttgtttacttctgaagagagttgagatttcctctcacaggcacttcattgattggaaacccatttgatgcttggacacttgcttttcagctgtgcaaggggttgtctgcagctgcctttattctagtaatatactaattgtactttgaaattatggctgttctggggtctccactgaattggcaatgtgttccgtgagcactctctcatctagctggtaagaactccaataacacagagtgctatgtgatctctatcttcttaattgagcttgctgttctcttgtagttgctgtttctcagtaaatgttctttgccacactttctgtagaaccattttctgtgcacatgcagtgtcatgtgaggccaactactggaggagacttctatgcgtatttgtagagctcctttcctccacaaaccagttcttatttgtagcggacctagaaaataccagagtcatcccaaactccaatccctctcctctgctcagctagatggctacaggctgcttgagctccatctccttgctattcagtgcaggaagggtatccaggaagaaagccaaggcatctatggagttgagctcatcattggccctctctcaattctctaggtcctctaccatctgttgtcccacatgtagaaaccatttttccatgtctttggttgttgattatggccaaatgattggccatggggtggtcagaccagggcttctatccatctacccatcccttttacttttcagcatccctctctgtgctgactctcatctgccttccttccttggatcttctcttgctgggaacctctatcctttcaggccactggtacttaggaccaagagattttctccctattggaatacaggtagaaatagaaacagatcaattcacctgtccataagtaagcacataaactttcctcatgagcccagacagaaaaggcaaacacaatcttcccttcaggaattggaagtcagaataacggaattccaactggaaagtcttcattgacgcttagtgggtgttgggcaagggtaatctaagtgtttggtggttcgtcattctgactttcttcataaggtgatctcctcgcctcctcatttcccttctgctccacaaaactaggaggaaggtgaggcagcttaacatttctcttctctcagacccttagctccaaggaaatcatcctgagacattttgctacaccatctgaatctgacacaagttgagttcggagaactcagcttgaagcatgtctcttgtcacagaaacttcagttggccctttattctcttatggtaaagaacaaagacatacgcatttgggtagtattctggggtccgactatgcgagtgtggtgtcatagatgaccaagcttggcaggttcttccagtgacagtggtggagtatgtgcctcgataactctgtccattaccgtggtagcactcctgcaccccaggcctctgctcagtcggtgctgaaatgaaaacacaagaaataaactgagtatctctgagaataacgaaatatgtgaagccatttatgacacaaccagaaaggagtctatgagaattatgaacgttatctttcccttacctgtaggcagatggatgggagaaaaccaaccaaaaaacatacagcaaacctacagattcctaccaatctagaactgtagtaagttctaggaaatatttcacctgaaatccttagaaaaacagaacagaacagactccttctcactgcaaagtgcgctcacgaagtagcacctttctatgaaactctactgaatgttcatacaaagggcactgcatttggcaatgcaggatgcaggtggtaattggctgtcgagggcagaggaggggaaagacatggaaattttgcatgtttccctagatcgttgatcatgaaagccaaggcctctggcttccaggccatggggcagaaaacgatcctatatatctgactgaaggcaaagacactttgcttctcaaggatgtgtgcacgccaaaaccttcttcccttggaggagggagggaatcttctcatgccctgcatcctgaattgcagtaaaggagaagtctactaacctttctctctagacccctcacaggtacaagtgccatcagaaagaggtttaagaacactgagaaatcactcccttcaaagcctaggactgaagagccttagagcattgggagctcatatactgctccatagacccaggaccatatggaattaatgcagccctgttaggtttctcgaggatgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcgtctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacgcacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgaccttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattacatctttgccttgttaccttcgaactgtgatgtacaaaagtacatcatacaggttgggttttttttccgaaattccctatatgatcccttgagtttcacgattctgtgattttttttaatgttcttcgtaattgaaaagttatcagccatccttgattctggtatttgtttctattataaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtgtgtgtagctcattctgtaggttctctaaaattgtgtgttgggtaatgttttcctctgaaacgtctaatttgatcagccggccatacagtaatttttttcaattaagacatactttttttatactagctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatattctaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggcagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacgcacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgaccttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattatatctttgccttgttaccttcgaactgtgatgtacaaaagtacatcatacaggttgggttttttttccgaaattccctatgtgatcccttgagtttcacgattctgtgattttttttaatgttcttcgtaattgaaaagttatcagccatccttgattccggtatttgtttctattccaaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtagctcattctgtaggttctctagaattgtgtgttgggtaatgttttcctctgaaacgtctaaattgatcagccggccatacagtaatttttttcaattaagacatactttttttatactacctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatcttctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctt

SEQ ID NO: 1133 - DNA, 152777 bp, Homo sapiens
atatgcaagggtatgtaaaagtctatatatagtcatatgacaaaggtatatggtgtattgaatttatacttttattgttcatcactaagacccttttttactttaaaagtgggttatatagacctgtgaaacatgcaacaaaaatgaaaacactgcacctttttgtggttctgtaaacacacaagaaaagtggaggtcaggatccatgctgttggccaggtattaagttggcgttatcagcaatcactgtagtctctgtgagtgctgatgaatctgaatgtcatgccttgggaattgcttttttgactagattactggtttgaggttgttgccgttgtgttttttgtaagagtagaaattcacaagtgcacaacgttggatttaggtaagtggaaatttaatgcaatcacagcagtgcctcatacaaagaaagtgatcaacaaatgtagccatgataagggtcactcgctaggccagttgtcacctacccctctgctggatgacagcccttctgcatctgcactcagctcccgcgtttccggagcttctcttctcagaccatgcagtgcccagagcttcagatctgtccatatccttcatcaacacctcctgaaagtatgagaccttgcagaggcccatgtcttccaggtgttgccaagacagctgagacagagccctggagtcctttcttatcatcccttgatcagggtgtcttatatctgttaattctacaaatagccatttttttaaatgtcatttattttaaaccagtagctcagctgtcctgtgccagctccacaccctcaactctacagctgattacacagttcattattatgctaatttaagaaatgttaaatatatgcaaacctacagagggaacaaacactgtagcaacttaccaactttcccacaacctgcagttaacaattgtgaacagtttgtcattttaacttttccccagtccctggaatttcctcatctctaacccagtctccctcaaccactcatgatgaagtgtgtacccatccaatctgttttggaacattttaaaattattttacttggttttttttaaatcagctttatatatgcacatagtttaaagagtcaaaaagttctgtccaggcatggtggctcacacctgtaatcatagcaatttggaaggccgaggcaggaggatcatgagtccaggagcttgagaccagattggccaacatggtgaaacttcatctctaataaaaataaaaaaaaattagctggatatagcagcccatatctgtaatcctagctacttgggaggctgaggcacgggaattgcttgaacccaagaggcagaggttgcggtgagccaagactgcaccactgcactccagcctgggtgacagaaggagactctgtctcaaaaaaaaaaaaaaaaagaaaaaaagtaaaaagttctgtttttacagaattactgcgtttccttctctccagaggcaaacacttccaattctttatttcatttatttttgagatggagttttgctctgtcacccaggctggagtgcagtggcacgatctcggttcactgcaaccttcacctccctggttcaagcgattctcctgcctcagcctcttgagtagctgggactacggcgtccaccaccaggcctggctaatttttgtatttttagtagagactgggtttcaccatgttggccaggctggtctcaaactcctgacctcagggcgatccacccacctccgcctcccaaagtgctgggattacaggcctgagccaccgcacccggccacctccaattctttcaactgatcctattggcatttaccttcagctctctaaataactttctgactgtggtacttcttttttcagttttagtcattacctattgatatggtttcgatctgtgttcatgcccaaatttcaagtcaaattgtaatccttagtgtggaggcggggtctgatgggaggtgattggctcatagggcagtaactcatgaatggtttagcaccttctccaggtgctgttctcctgatagtgagttctcaggagatctggttgtttaagtgtgtgtggtacctcccccacccttgctcctgctcctgccatatgagaagtgttttccatttttaaaattatagacatttaaattatagacattttaatggatatgaagtcttatttcattgtgattttattggcatacacagcatacacataccgtccacataccacacacatacacttcacacaccgtacatactacatacacccacacatccttttgccatatgtacctaaaataattatgtaattatattgtaattttggttaagtaaatattcagtgtttatgtaactgaggcctgtagtatccttttatatttctccctagaattcattattttcttttctgtaagcttttatgtctgtttcctaattccactccaaattctcagttatataccttttcaatatgcccccaaaccaatcaggccatctagcgtttttcttccagagagctcctcgggaaccaccggctctgctctggtgtggcctgggtgcacagccggcctgctgtgcagttgtgggatctccatggactgtcatccagaagaccccctttcctctctgatatttgatcccgtttcatggatcccacatcttcctttttaaaaaaagttacttcctcattttgccaaagcaaatattctagtatcatccttagaaaggatacatggaaggtattttttaattgaagtgaaattctcataagaaaagtagcagtcttatagtgaacaatgcgttgtatttagtatgttcacattggcaaccaccacctccatccagttccaaaacattttcatgaccccaaagcacaatgcagtacccaataagctggtactttccatgaccccatcccagcccttgctttcaagtttcagccatgtagcggataccagtacttcattcctttttgtagctgtataaaccacaatttgtttatcccctcatctattgattgacatttgggtgtggctgttgtaacagtgctgctatgaacattctcatgcaaggtatctgtttgggcacttgttttcaattcttgtatatatacacctaagagtaaaattgttagatcacatggtaattctatgtttagcattttaaggaactgtcaaattgttttccacagtggccaaaccattttccctgtacattcccaccagcaatatacaggattctaatttctccacatcctcacaaatgcttgttattttccattttttaaattatagacattttaatggatatgaagtcttatttcattgtgattttattggcattttcttaatgactaatgatgttgaccatcatttcatgtacttattgcctatttgtatatcttttttggaaaaaatgtctattcacgttcttgtttttctttttattgttgagttgtaagagttcttttttttttttttaactcatttcccatttgccccaagaatactatgcaggcagcaagctacatattttctttttctaaataagaagtgggttaagagatggcagtctcactctgtcacgcagcctggagggcagtggcccaatcatagctcactgcagtgtcgaactcccaggctcaagtgatcctcccaccttggcctccccaagtgctgggattacaggtgtgagccactgctcccagcctagagatcttaatatattctggacaccaggcctttgtcaataggtttgcttcatcagtaggttgcttttcactttcttgataatgtcatttgacacataatagcttttaatttttttcattacttttcaattattttttccagttttattgaggtacacttcacaaataaaaattatatatatttaagatgtacaatgtaatgccttaatatagatgtacactgtgaaattattatcataagctaattaaaatattcaccacctcacataatacttttgtgtatatggtgaggacacttaagatcaactcttttagcaaatttcaagtatgcaatacagtattattaactctagtcaccattctgcacattagatctccagaacctatttatcttgcaaagctatacagttgtatcctttgatcaacatctctccatttcccccttccacggctctggcaatcactaagctactctctatttctaggaatttgactttcttagattccatatgtaagcgagatcacacagtatttgcctttctgtgtctggcttatttcacttattataatgtcctccaggttgatgcaaaggcaggattttcttcttcattaaggctgaataatattcctctgtgtgtgtgtgtgtgtgtgtgtgtgtgtgtgtgtataaaacatatatatatagatacacatttttatcatccatcctttcatttatttatttgtgtaagttgaactattcttgcattcgtgaaacaaatcgcacttgatcatggtgaatgatctttttaaagtgctactggattcagttttctagtattttgttgcggatttttgcacatatgtttatcagggatattgcctgtaatgttcttttattagcgtattatttttctgtgtttagtatcagtgtaatgctatcctcataaaatgaatgtgaaagcattccttctttttagtttttaagaagagtttgaggagggttgatattagtctttgtaatgtttggtatgcttcagcagtgaagccattaggtcctggccttttcattgatgggagacttgttattactgatacaatcatgtacacattattggtctgttcagattttctatttctttctgagtcagtctttgtaggttttttgctctaggaattcatccatttcttctaagttatccaatttgttggcatgtaattattcatagtagtctcttatgatcgtttgtacttctgtagtatctattgtaatgtctcctctttctggttttatttgagtattctctgtttttcttaatctagctaaaagttggtcaattttgttattttattgaaaaccaactagtagttttatttctttttggtatcagttttttagtctttactatttctgatgtgatctttattatttctttccttctactaacttttgggttagttagttctttgtctagtttgttgaggtgtaatcttaggttgcttatttgagatcttcttttttaatggaagtgtttattggtaaaagcttccctcttaaaaccacttttgctgcatactataaattattggtatgttagtgtgtccattttcctttgtcttgagttgtttttgttttcaattcaaaatcatatttattatgttttaaagcaagtgacttattttagtataggatagattaactcattccaaatgatagctttctccaattaaagctacattgttaaaacttgaaaaaattatccagaatttatctttcatggtgatacttaatttcagtagggcttttcacattttgtctgattggcatataaatcaaaaacaaatatttctttttttattattatactttaagttctggggtacatgtgcacaacgtgcaggtttgttacataggtatacatgtgccgtgttggtttgctgcacccatcaactcgtcatttacattagatatttctcctaatgctatcccttcaccagcttcccaccccctgacaagccctggtgtgtgatgttccccgccctgtggccaagtgttctcattgttcaattcctacctatgagtgagaacatgcggtgtttggatttctgtccttatgatagtttgctgagaatgatggtttccagcttcattcatgtccctgcaaaggacatgaactcatgtcttgattttttaaaatttcctcttttaatatcttcttcgactcattgattgttcaggagcatattgattaatttctatctatttgtggattttccaatattcccccattattgatttctagtttcatacgattatgatctaaaaaaaaaacctgatatgatttcaatcttcttacattttttgactagttttgtgacctaacatatgatctattctggagaatattccctgtgcacttgagaataatgtgtattctactgctgttggatggaatgttctatatatttctgttaggtctacttggctaaagtgtagtttaagtctcgtgtttccatattgattctctgtctggatgatctgtccattagtgaaagtggagctattcaagtgtgctactatgattatattacagtgtagctctcctgtgagatctattaatgtttgttttagttactatatgtaggtactacaattttgggtatatatattaatatatatttataattgctatatatttgtaatgaactgatctccttattattacattcttcttcgtctctttttacagtttttgacttaaagtctgctttacctcatgttgagttgagtttcccttatccaaaatgcctgaaaccagaaatgttttgaattttgaattgtttttgcaatgtttgcattatgatatggtttggctgtgtcccacccaaatctcatcgtgaattgtaaccctcatgatccccatgtgtcaagggaggagcccagtgggaggggattggatcatgggggcggttttccctatgctgttcttgtgagagtgagtgagttcccacaagatctgatggttttataagtgtttgacagttcctccttcacacactcacactccgtcctgccaccttgtgaagaaggtgcctgcttctccttcatcttccgccatgattataagtttcctgtggcctccttagccatgcttcctgttaagcctgtggaactctgagttaattaaacatctttcctttataattactcagtctctttgtagtattctttatagcagtgtgagaatggactaatacaaattatatatttactgtttttgcatccctaaacacaaaaatccaaaatgctccgaagaacatttcctttgaacatcatgttggcacttaaacatttttaattttggagtatttcagatttcagatgtttggattagtgatactcaatctgtataactacccctctatcttcttgtttccatttgcatagaatattttttccatccctttactttcagtctgtttgagtccttacaggtgaagtgagtgtgttataggcatcatatagttggatcttattttttaatctatttggccactgtatgtctttttattggaaaatttaatccatttccattcaagataattatttataggtaagatctgctatcaccattttgttaattgctttctggttgttttgtagacccttcgttcctttattccactcttcgtatctttatttgtgattaagtgattttctctagtggtatgctttgattcctttttatcttttgtatatctactttaggtttttgctttgtggttacgatggtgcttacaaaaaaatcttatagttatatcaggctattatataaggtgtataataacaaaatcctccgagctaaagcagcatgttctaacccaatgcaaagaagctaagaaccttgaaaaaaggttacatgaattgctaagtagaataaccagtttagagaagaacataaatgacctgatctgactgaaaaacacagcataagaactttgtgaagcatatacaagtatcaatagccaaatcgatcaagcaaaagaaaggatatcagagattgaagatcaacttaatgaaataaagcaagaagacaagaatagaggataaagaatgaaaaggaataaacaaaggctccaagaaatatgggactatgtgaaaagaccaaatctacatttgattgatgtacctgaaagtgatggggagaatagaaccaagttggaaaacactcttcaggatattatcaaggagagcttccccaacctagcaagacagaccaacattcaaattcaggaaatacagagaacaccacaaagatactcctcgagaagagccacctcaagacataatcgtcagattcaccaaggttgaaatgaaggaaaaatttctaagggcagccagagagaaaggttgggttacccggaaagggaagccaatcagactaacagtggatctctctgcagaaacccaacaagcccgaagagagtgggggccaatattcaacattctaaaagaaaataattttcaacccagaatttcatacccagcgaaactaagcttcataagcaaaggagaaataaaatcctttacagacaagcaaatgctgaaagattttgtcaccacaaggcctgcctcacaagagctcctgaacgaagcactaaacatggaaaggaacaattggtaccagccactgcaaaaactaccaaattgtaaaggccatccacactatgaagaaactgcatcaactaatgggcaaaataacccgctagcatcataatgacaggatcaaattcacacataacaatattaaccttaaatgtaaatggactaaatgcccccaattaaaagacacagactggcaaattgaataaagagtcaagacccattggtgtgctgtattcaggaaacctatctcatgtgcagacatacataggctcaaaataaagggatggaagaatatttaccaagcaaaaggaaagcaaaaagaaaaaaaaaagcagggattgcaattctagtctctgataaaatatactttaagccaacaaagatcaaaagagacaaagaagggcattacttatacaaaaattaactcaagatggattaaagacttaaatgcaaaacctaaaaccataaaaaccctggaagaaaacttaggcaataccattcaggacatagcatgggagaagacttcatgactaaaacactaaaagcaatggtaacaaaagccaaaatagacaaatgagatctaattaaaccaaagagcttctgcacagcaaaagaaactatcatcggagtgaacaggcaacctacataataggataaaatttttgccatctatccatctgacaaaaggctaatatccagaatctacaaagaacttaaacaaatttaccagaaaaaaacaacaccatcaaaaagtgggcaaaggatatgaacagatgcttctccaaaaaaggcatttatgcagccaacaaacatatgagaaaagctcatcatcactgatcattagagaaatgcaaatcaaaaccacaatgagataccatctcatgccagttagaatggcgatcattaaaaagtcaggaaacaacagatgctggagaggatgtggagaaataggaatgccttgatattgttggtgggagcataaattagttcaaccattgtggaagacagtgtggtgattcctcaaagatctagcaccagaaacaccatttgaccctgcaatcccattactgggtatatacccagaggattataaatcattctgctatgaaaacacatgcacacgtatgtttattgtggcactattcacaatagcaaagagttggaaccaacccaattgcccatcaatgttagattggataaaatgtggcacatatacaccatggaattctatgcagccataaaaaaggatgagttcatgtcctttgcagggacatggatgaagctggaaactatcattctcagcaaactaacacaagaacagaaaaacaaacacggcatgttctcactcataagtgtgagttgaacaatgagaacacatggacacagggagggcaacatcacacacctgggcctgtcaaggggtggagggctaggggagggatagaactaaaagaaataccgaattagatgacaggttgatgggtgcagcaaactaccatggcacgtgtacatctatgtaacaaacctgcacattctgcacatgtaccccaggacgtaaagtctaaaaaataaaaataaaaatagatgggatgaaaagagcatgaaaattttgaagaccaaaaccaaaattaattcaaatcaaaataagtgcagagtttatttttaacaaatgtcatagctatgacaccttaatacagaatttgtcagtcagaccttaaaagcttatacacaaaaataccaaaaatgccaaggtttggcatagctggtagctgggaacagtgtcttcgtttgattgctgtctattatttccagcatgctaaatccttacccacgtttcagcttctaagtaggttgatgcttcactctgtctcccgtccaattaattatttctcatcattccctcaatccaagtaacaaaccttgaaacacgagcatagacaccaggcttattggggcgtgcacagccaagaccccaagaagtgactccttgtaaaatgtatttgtccttctcgaagcaaaccagaggccctccactgtcaccctaaacagaggtaggggaaaattcatgtgagctttaagctgccaaccttttaatatgggatgccatccttctcttatccatatgtacattttcccagtaattcaaatcagaaaggaacttatgagcatattactcaagcatctgcagtgcttaagtacttagcaaagtctattcaacaaaaccacatcacttagttttttcctgggaaaaaaaataatcccttgtgaatcctgcatgcattgcttcctaacttggtgtttcctttagactgggctagcctggacatcattgttaagtgtgtgtaatttgtctcggtcctgtaccctctaccttcctctctactggaaaagccaccacttcagtcactggtgaccagcacacaccaggaaggtgagtggcctgaggtagttatggcacttacggctcccttgctatggatctggaactcaagccccaagacgtctccttagatgatctgaatatgcattcagggacagatctggggagtttctgagcaacacttagactggggtcttccactgacaaaaccttcctgaatttgccactttgggactgacgtctaagggactgagactgagacgggagagcacaagactttgatctattgatcttttcttacctggcaactgtcagtgcctctggccaaatgctcagcacaaatatacttatagtgattgcacacttcattctcaataacaaggagctgggcttccttgagaaggccagtcccaaaggtacctgtgtttaaaaagatgaaagaaatggttactgaggccaaagcttgttcacgaggaaattccagaagaacagagcagtggagctggacctcctgtctgtccgtgaggctgcagaacacaaggcagctcccaatgccactggactctctgacccattaaagtgcaaatgtcatataagattttatgttcccaagacctggattcaacaatctgggctttgtcatgctgctttggggttggttgttgtttgtgtactttttgcttttcttttgaagctatcaaaatgatttttacaatgtaaagagagtctgagaaatacaattgctattctttttatatacttttttcagatttttatatgcttcttttactattacatcataatgcacaatttcctatactgattttttcaatcaatgttatatcatgagtttttaaaaaaatgctacagtcttcataactaatattttaatgaggagtgactgcttaatgggcatgaggtttcctttggggatgagaaaaatgtcctggaaatatggtgacggttgcacaccattgtgaatgtactgaatgccactcagtggtacctgcaaaaatggttaaaatagtaactctatgttgtataaattttattgcaataaaaaagaatagtcatcatttactaagaatcaacctttccaggcacaagctcataatgtggtatatctcacttaatcctcacaacggtcctatgaaacaggcacttgtcattcctgttcttcagttgaggaaactgaggcgtaaggaggttgtatagctcagcttgagtctgggtctgcggagtcgctgcccaaatgcttcctccccatgcgtgttggccccactcttgcttccaaccttccacatgtttgttcataaatttcattcttattccttattactttctgaagtctcagttcccataattatatagacatatttctatctcacagtaacattgccaaattattctctaaaagggtgtgacagtggaaaatgtcactggaaaacaattactttgcctcacccttgtgatattcaatttttaaaatattagctaacatagtaggtggaaattgtcctgattcattttctaatttacacttccttgacaattagggagaagaaatactagggacaattctcctcgttgtagttcttcttttgtgaaaaactgcttaatttccttcgccaaattgaaacagaacctctgctaaagtgccagaggaaatgctgtttttccagatggacatgcccagggatttctcagtgctctcacaaataatccaagtttccaatgttgcaagcccagctctcattagaattttgcaaaactttgcaagcatggcacaggctagaactgaggcactctctcctgctttccccaaagcccttgactgcacttagatcattgtcttcggtgtcagaaaactgacaccgaatctggagtttacatgagcagcgtggaagagtctcttccgcagagctgcatggaggaagctcctcctgactaccgagcattgggcatgggatgcatcacctggactgcacagatgtgtaaaggggcacccttctcaaaatattttgctgaaagttaagttaggtgtcactgctctcagatttgctctctgagcaaggcaaacatcctgataagagggaaaacccaccaggagttgctgggaaattaatgcagtctatgagtatgtgctgccatctcgtggccaatgtagagatggcacctctgagggcagggtgggccacaggtaacctgaggattgaagccctctctgatggcgccctggagacagggccacgggatcagcccagtgattgcagatgagacttacatggatgagccccttggcctcaacaccactctgcacttggtacatccaaatccgggaaggtctggacacatgaaggggagagggggagaattttgacctccttctgagaagctgagaacacccattgatctgatgtcattattaacatgtagaaagttgataagcaggcctgagttatgtatgtggctcctcctggtctagttggtgttctgaaaatccttttctcagtggacatgtgggtgagaccagaggagactgggagcccagtgcaggatggtggttagaaatgtgtggatgggggtgggagagaggaaacagtgagtgggctctggggtcaacacccagctacaccctggttatgtgatgtttatttatgatgatggtggtgatgattaaaccaatggtgatagtgatggtgttaatgatggtgatggtgatggtggtgctggtgatgatggtggtgctggtgatgatgatggtggtgataatggtgatggtaatgataatggtgatggtggtggagtagtggtgatggtggtgggtagtaatgatggttacagtgatcattgtgatgatggtgatagtgatcatggtggtggtgatgatggttacagtgatggtggtattggagatggtgttgatggtgattatgatggtgacgatggtggtgatagtgatggtggtagtaatgataatacagatgaggaaatatagaggatagtgatgatggtggcagtgataatggcagtggtgatgatggtggtgatggtgatagtgatgatggtggtggtaatgttaatggtgatggcagtagaattgtggtgatggtgatgttggtagtagcggtggtaatgatgatggtggtggtgatggtgatgtcatgctgatagtagtgggacagtggtgatggtgatggtggtagtagtggtagtggtagtaatgatgatgatggtggtggtgatggtgatggtgatgatgttgagagtgatgatattggtgatggtggtggaatggtggtgatggtgatggtggtagtagtggtagtggtagtaatgatgatggtggtggtgatggtgatggtggtaatgatgttgacagtgatgatattggtgatggtggtggaatggtggtgatggtgatggtagtgccagtaagaatgatgatagtggtggcgatgatgttgatggggatgatggtggtagtggtggacggtgatgatgatgattatgtgtaatcttaatcctcacaattatctcatatgtaagatgagaaagcggaggctaaaagagattaaataactgcccaatgtcacatggaagatgggagagccagaactcacacccagatccttatgattttagcttcatgctttcatcagttgaggtatcatagaggctctgtttgctttctggctgcccagcagctttttgccctacctcccataatcctcttgaaggatctatctaacttttgccccttatgggtattagtggggtcttgccttcacctccaacatggaacaattggtgcaggtcagagccagtcagtgatgggttcaggggcaggactgtgacccaagtttgacttctcagagtgggcagactattgttcacataattgggagagtggcctttcttattctttcccggtacagccacagcaccacagcatctgcagccatgggaatgtcacctttgtgcccccaaatagtgcctactccatgattgggaggacctgggatttggggccatcatgtgagcctgaaaactttgcagctcactaagaatttcccttgttttgcttaatccaatttgagttggattttctgtcacttgcaagaaagaatcatgttagatataattctattctttattagtagtaggagctgccatgatggagtgcttaggatgtgctcagcacttgatgcactttcttattatttcccccataacagccctgcagcccacatcagctgaggaaacaatcagcgagagctcacgacttttctaagtcctgacagcccataggcaggagccagggttccaattcaggtttgtctgtaccaccctccaccttctctgagccccagcttcctcaatggtaaaataggaacaataatacctaactcacagtggtttgtagcatttaaattttaaaatatgcaaacaccaggagcagcctcccacacccataggtgcccctcatttgccaagtttccttttacctggcctcagtgctcccagactcagcagtgcagaaaaagggaacaaggagtcaaggaggtgaggttttaaaaataataggaaaatgacagaaaaagggaagcctactttgaaattatctaaacctgtggtttttaatctttttaaaaacacaaaaaacattttatcaaatcaaagcttatgcaaaaggctgatgtgcaaagcaccatttgaaaatgctggttttacagataagggattagagccaagtggtacaaagaggtaacgtgtctagttcaggtctatctggcaagtggcagagtcagaacagttttccagggccccagactcccagtgcccttgcctgcacctctgagaaagtagagctgagactttaagacagtttcagttttcctactgccaagggggtaaggctgacggatataattattgtcagggcataccgcaaagagaagaaggaatccataaaatgtagtacaggtgctgataccacatcatgcacaaaaatattccctctcttgctctcacccatcaaccaataccaaatgccatcctagacttggggccatgggaactgtctgcctctcccccagcttcaggtcccctgcctaacaccctcacacacacattagacatgtgggtatttgggaagaagaatagtttaattacaacttttgtcgttactgttttgcaccatgtttagaaacgcagtctgtctaatttcacatgaaaaataatctaacacccttaacttgagggctgggtcaaaaccccacttacctggggaagcaatatgaatgctgaaattatgattaagagactcaaagacctctactggtgtttgtttttgttgtaagggaaacatacaatcattacaaaaaaaattaaaagattctgaaaacaaaaaagagagagactcaaggaaatggcaccgctccccttgcccaagtcccttgaagactgattatggagacatagacaggtgtccaggcaaagtcaggagtgggtagaccacattcatgggtaggaatttgtacaactatctccaaaatgctcattttgtaacatgcactgaaggtcaaaaacaatttgttacgtgggcaatggaattgatctcaccttgggtttctccccagccagtgatgtaacattcagtcctggcggtgaccatgtagtctggggatggcagacaagctggcattactttgtcagtgatgacggcaggcctgtaaggaaagtattagcagttatgtttcactgcccagctggaagtggcagtacctacaaccaggcatccctgccttgaagccccagagccctctgagctggcactgccttgcttcactgacacagaacaatgtagaacacagcgtttcaccctcacatttgcctgtggttgcctatggactacacagatgtaaggtttcatttgaaaggcatcagttgcatgcaagaaactgagggtggccttagcctttgaaagtagggatgacaaaggcacacttctcatgtatattctgtgcacgattggaatctcatgccaagtgtgtcctttcatattaattgaagagggcattgatgactgggcagaatgtctggctgagacatcatcaagagggtataaaattgcaaatgccttgtgtgcccagagcaagttgctccatctggatcctccacttcctcctcgtgaatgttactaaaccgtggtggtaagaatgcagtaaaatgctagacatcaaatgaaagaggatgggaaataagcaccttgcatgaactaaatggtattgttttccaaggacattcatataccttagaatcccagggactcttaaagattagaactctggtttttagacctgattctactttagtaagttcaaggggataaaggaatggaaatgagaaatgccgtattctgaccaaaaatcatcattagcaccaactttgaagcagacacactttctgcttctggacactagaaggcccagcctgtgatgcagatgtcctcactctacaggttccctcatggagcactaaatgccctagactctaggggtgtggggatgtgcggtgggaactctaaactcaaaacgtatcagcctatcagagaatgcctccaaaaccccacatttcctaagtgacttgttcaagccatcagaacaccccagctctctgaggaccatgaggagcagagatcttgtatttgcacatttgctgggatggtggggaggaccctggggagcaagagggagatcagctactgtttataaaggctgagccagaaaggcccttctctccttcctagagtgtcagaggattccaggacatcacccctcagttcacagacccagagaagctgccatgggcttgtgaccaggcccaggagagcagctcaggctcctgcctgccccatgccttcccaaccaggccatgctcatccctgtctgcattgacaccctgccttccagagccaccagcacagcgagcaccccacatgccttgtcacctgtcccaaacctgcctctcctacaaatactgtttcttagctgattgtactgtcacctaggtccaaatagactaactttaagtgatgtaagcaaaggtatcactttgtcaggcttaataaaacaaaatttcaccaggaaagagaaaatcaaagaagacaacaataatattattatttgcatttgtaaattgtatgttgtgtgggttttttttttttttgacattgtggaatatttctgttcatttgttttgttttcttttcttttgttgagacagggtcttgatctgtcacccagcctggagtgcagtggcacaatcatagctgcctacagccttgaagtcctgggctcaagcaattcttcctcgtcagcctcctgaatagcagtgattagaggcgcccacactaagcatggctcgatatggtggtttttcaagcgctttgaaatgcaatctcatttgattctctccagcatattattatgaaaggagaatagttagcctggaataacaacctttccctgatcatgaatgtggatgaactggtgaacattaagtaagttttacgggtaacagggtatctctttttccacgtgaggaaacgaatccttctgcctttttaaagagcacaactaacatgtggcagggctggggttgaagattgatgctgtccccaaagcccttgagcctttcatgtgatagacagttcctccccactgccatgcagtggccatggcccataaaacccagacataaagcaaatatcttcaccagcgtggggtgaagaccacaggtgagcgagtacctgcttagctttagcaaggcaatatctgcttgtgtgggctccaagaacagcctagacacttctatttcctgaacatgagattcgaggttcacttcttggtgtgcacccaggatgaccttgtaggatgaaggccttgaggacctagaaaagatgaggatgtcaagagaaaaatatggtccagccccttcaggtatcctctgtgccatgaacttggcgctgtccctctgacaccctcggccacccagaatcagtgacttatgagtggcaagaaacaaaattcacaatttgctggaaactgacagttaaggtctgttctcaatctgtttcatcagagactgtgatatagtttgtatatttgtccccacctaaatctcgtgttcaactgtagtccccagtgatggagctatggcctgtgaaaggggtttggatcatagaggtgcatccctcttgaatggcttgggccacatcttcatggtgatcagtgagctctcactcttagttcttgcaaagtctggtcatttggtattgtgcagcacccccaccccatctctctctgtctcttgctcctgctctggccatgtgacatgcctgctcccactttgccctccaccatgattgtaatcttccttaggcccacacagaagcagaggagatgacagcatcctgcttcctgtaaagcctgcagaaacatgtgccaattaaactcttttctttataaattattcagcctcagatattgctctagagcaatgcaatacagattgatgcctctggtagtgaacagctctgtcctgcggtttatacaggtccaaaaaatcacttgcactgggtcttccctctgcagattccctctagaaacacttccctcctctctcatccaattgccctggaaattctgcctcaggattctgcatgcattccctggttcctagtgttccttccagaaaaggaagagaggtggggaggaaggaaggggagggtgggaagaaagaagggatggaggaagagagggaggaaaaaagtcttgaagataagaccccatgtcagttttcccttaaacgtacttcttcaagcagtgagcagcagtcagcacccactctggggatattaaggtgcctccacagaagtgctttccaaacctagaaagaaaacatgccaaggctttggtcaaattggatggtttgttctacttcattgtacagaaagccaggaagacaagttcactcagttttgatcatgttcatattcccaaagcaaaggactaccgcccaacgtcaggatagtagaaacttcgagctgtgctccagtagtgagatttttcagaagggcccatctgtgccactttttttgatgcctgaggcaagaataggcacagcctgtccccaggagagcaaagctaagtgactccagaatgaagctctatagctgtggctttcaccccacagccctggactctgacaaaagtgaccagcccaagaccttcccaaggtctctttcattttttatgacaagatctatgcaaggtcactcttcaaggagccagatacgatcctgagcagcagtgactcatgagggtcttctgatcttacctgaaaagtttacttttgggggatgtttcttgactcacttactttctaggactgtgtaggcagttgatagatcagaataatggtgtgagccacttggagccagattgcaacgaagaggaatagagataggaagtgcatgatggcagtatgttgatagtcagtgaggacatagaccaccacacagtttaggaaagaatgaatctgaaatatgtggaaggtgaaagctctgtagagcaagaagttacaaacgataaagtaaagaaaaatcaactcaacagcagagtgaaatgcgatgcgatcaggtttgtcgatggcatttcacaaacttacagaaggaagtctctttagaggagaacagcaattgagcacaggtgccctggtgtagaaaggagatgaggaagcaaaacatgcaggcagatgggtctgtgtcctatgtgttcttcctaagagacacccaagcaaactgaacttacgaattgcatgttccactgaaacgatacccaaaatgtccaggttctgtgggttcggactgattactcttcatttatggggatcacaacccataatttgttcatgtgtttgtgaatagatgaatagcctcggcattgaattcaatgattcacaaaagtgtaaaaaaaaatctgtgcctgtgatagactgtaggtaagtttgctcttgtcctccctcactgcaaagtgtcacatttctaaaaacttccctttcttttcatctgacagtgagacaatggatatccatagaaaccctcagagcatcttcaatattttccaaaagtattggaacttggtgcaaatcactgtgcctacagattttgatggaactgcccagatcaagaaaaagatttgtattttggctattttccaagtagagaacctataataatataactttttttaatttttctatattttttcctccttcagaaaacagagaggcaggtattgatgcatcagctgtgtgggttctgtgtaaatgtagaagggttttgtggggcttacatggaaggacagtatagatggtttctgggcctgttcttaccttgttctgagactgacttgccagggccaggaatgtgggtgggccacacacccccctacaatgcttccaggacatttcttcggctccacttgaggcttcccacaatcaaatgaagaggatgctgtggcacaaggtgggaaaagaagtcgcatttgagtccaagttagcaattgtgtcgtttaattcaggacgaattccaagcactagtttttcacatctcaaaggtgaaattaaatggtaaaatcataaacactctttagatttttctttctaagtttaaaaagtggtagtaaacaacaaaggacactctcctttcaaggaaatataagttctttctaaaccatgtaaagtttactgaaaggcacaaaggattcttttgcatgtgagtctctgtgtgtggacatatgtgcatgtgtgtatgtgattttatgtagcaaggataactgtcctatgttgaaatgttgccttctctcagccagcttcaggacagttcttctggggagcctcccatgactaactgactgctgtgggggtaatttacacacatgtgcctctattcttcttttcctcctccctgccttctctctgcagcaagcccacaaggtctctggaggtagggaaagtgtcccatctttggtaccacccatcaatgcctacaacagtgcaggggctacagagggtgttcaaaaatgcttctctgttgtctccagcccttcaaggtcttcaaaactataaatattaatatagttaataattattcatataattattaataacaactgcaagaggaaattcctccccaaccaaccagagattctacactccagtgaatctggaacctgagttttccaaataacttttcatttgctgtgggttgttttgagaatctatctatagaagtcttttgtaaaaaagaagcatggcatggaatgcaatcatcttttctagtgctgagctcaatttctgctagtatgccttacatacagtaaacatgcatcattgtactaaaagagtaactacagaaattataccctactcctactattcaaaataaaactgaatgtttctatttatttttacttatttattattcgtactgaatgtgttggtggaaatgaaatagttattaaactctttctccaaccagaggctctaactttctcaatcatgagtcaaacctgaatatcccaccaaccacatccttctgcaggaaacagtcctcaggatttccaagtgtctgatgggaaccctcctcaccaggcttggggttaacctcacttgtcttacatcaaagtaaggtggggaacctcacagtccattggaagaaatcttgttcccattcttccttctttctccaatctctaagaacctgattctcatacatcctcaatgtgggtgaggacagcagaattgcacctgggaagctactgcacttcccttccatgggagtcaaaggtgcatgagtcccaggcactactgtgggtgtttgaggcaggtaagtcagactgggcttaaattcaaggcagcctgtcaaggatagagagcccaggcagtgagaggcagtggcgtgtactagatggggccagaagcggagaactggaactgaccccatcaagagactttgaggtagaggaaccaccaagatgcttctgcaatagcaccgacaaaatagaacaaaagcacccactcgagaaaaaagtcagctatcaactcacactaaatccagagaccacaatgccacattataataatattggccaagtagaatctttcctatcaccctaacctctccttcttccctcttgctctccccaggagtggcccaaatgtgacgatgggcagtgtggctcccatgatcttcatcactgccctgtaccacctccccaggcaatctcaggatgctggtcttcagtggacttggaggccaaccttcttcccccagctcaaggtcccttcacatggcagacccaaccacaagcaaccaaattacacaaaagaaaagtccagggtggtgttctgtaactcggacagacaagttgattggtcagcaggaagaaaatagggaacaagtacaagtggctttttttcccccatggatttgttaccccaatcatttaagatctaatgtcaattccccttcccctgatccaagcctcatactcccaataagagtctcagagcaatgaggaaggaacctaacaagcagtctctaagcaatgtcgctaatgggactcatgagtagtaatcttacgagaaaggccatctggggctaaagagctgcactacccttcattgatttcctaggatggccatctgaggtttacaatgtgcattacatgcttagctgtttcctgctgctcgtattttttttttcttctcagctgcagaagaggacagtttttcatcataatgactctaaatttgtttttcatgcatcccacgctagacaaagaagggttcggtgggactatcccgggctgattagatcacctctaagtttgccctttgggaatttgacatttattttatttatgtgtgtgtggtgggaggggcgggtgttttcctaacaaatggggccaatagtagggcaggttcaaggtggccatgatgaaaagcaggctctggtggagagggcagccatctcctccccagaagcactcagctcaaaagccattttctgttttttttgcttttttttttccaaatccatattaaggaagcagtttccttaccaaaacagaaggcaacttaccacagagagggatatcacagtagtcaaaaagttttcttggattcattgtgtagcaccagggaccattgatgtcaccatcagggttacggcagtactgaaaacaagcaggcatgtaagctccagctcacgtggagcaggagagggagaagatattctaaggcacacacatttcacatctattcttagaagacaaaagggagcgttccttcttcctttctatcattattatattttttgacaaagttatttctttctatgctgtaagccatcagtcatagtcaaaaggagttatgaggccacacccttaaccagggtgtggtgaccctgaagggtctttggagaatgtgccacttctccaggagcttgacccactggaggtcttagagctagagcctcagaggacagtgggacatcattgatgagctttgtccctggggcgctgaggggtcttctacctgataaagcctgtttgctgttgattcagaaatgcttacttccatgcattatgcaccatccacagccaagacacacaaaggcagtatcatccttagcttcctgtgatattgtgatagaataagaaatgtatattgggtctctgccccccagttcttaacacagagctcctaaatcccttggagtttcctgggtgaagggagctgcaatgaagcaactcttggtgggttcctggatagccccaggggctggttgccaagggaaccaaccatgtgacttgagggttggaactgttcagccccaccctccaacctccagggagggaagaggggccgaaggtgagccgatcaccgatggccaatgatgtaatcaactgtgcctctgtaatgaagcctccataaaaacccaacaagactgcacttggagagcttctgggttgctgaacacttagggtactggggactggtgcactggagagggcatagaggctctgagccccttcccacgtgccttgccctgtgcatctcttccacctggctgttcaccaggatcctttttaatatcttttataataaatgggtaaataaaagtaacgtgtttccctgagttctgtgagccactctagcaaagtaatcaaacccatggagggtcatatagaaaaacagatctttatccagctgggcagaagtacaggtcacagcctgcaacttgggattggcatctgcagtggggcagtcttgtaggactgagccttaacttgtgggatctgacactgtctccagatagagtgtcaggaccgagttacattgtaggacacccagctggtatctgctggagactcgcttggggtgtgaggagaaatccccccatatctggtgtgagaagtgttatgttacatgggtgtgagagtgggggaacacagacactttggtttttcctatatctcagtcttccctattcataggccccaaagtaaaccatcacagagaatgcatgaggctaagggaagtctcatggtgacctgatggcccatccaaatcttttctagaaaaatctgacttaagcctcatagagggcatctctgactactagaacccagagcagtgtggttccccaacttttttggcaccagagaccagtttcataaaaggcaatttttctgtgcacctggggtgagggggcgatggttaaaggatgactcaagtaccttccatttatcgtgcactttatttcaattattattacattgtaatatataatgaaataaatgtgcatctcaccataaggtaaaatcagtgggagccctgagctaattttcctgcaagtaggtggtcccatctgggggtgatggaagcatgacagatcatcaggcattagattctcataaggagcatgcaatctagattcctcacatgtgcagttcacaatagggtttgtgctatgataatctaatgctgcctctgatctgacagctggcagagctcaggcagctatgagagtgatgggaagcagcagaaaatacagatgaagctttgtttgctcccccgaagctcacctcctgctgtgcagcccagttcctaacaggccacagataattaccagttccagtaccagtaccagtaccagtactggagtggggacccctggcttagaggacaagcactagaaacgagaaacagcacccaacaatggaaacagtaaagaaatgtcaaaagagaagaggcctgagaacccccacacgcgtggggctttgctggcctgtgctgcttgcactttccatgctaaggctaattacgcttagcctcctgaagtctttccagtattttcctctgcccctcttctgtttgaaaagatttgtcagcaaagggaaaaagagtccaaatcaaagtggcttacatttttttccagacctgcccatttatttgtccctggaatgaacgtgctgtgtctatggggctcctgggcagcccattcctggcatggcgtcccagtaacagtggttgccttcttgccccggtatcctttcccattcccaaacatacagtctgtagaaaaaaataaaaataaaacagatgattacagacagccaggcagccacatagacccaggacgatacagaatcaatgcagtcatgtcaggcttctctaggacgacagaatcaggggccacatccctcaggagccacaacgctgaagactgcaatgaacactattttaagaaattactggaaatgcttattggcttggaaataatcacacagttgacagcatgttagaataggaatttgactgggacactgaaataacccattttagaataaggtgagtggttaagttgagcaccctggaggttttgcgccagtcctaaagtcactactcccacaagttgtgccaaaaatcacagctctggctttcccagggacggcactgagacttccttggtcatggcagaacctcaaccaacactcgagctcccgtgtagcactaaaggcttctgcatcagtgtggtttttcatgtcttttcatcccgttgtccaagcacatagagaggtatgtgctagacaaggtaagacacagacttcttaccttgttcagaaggaggccctaggcttggaacctggatgacagtcggaggagcgaccacagtcccttctgtgtctgagcatcgcgtcaggttgcagtactcccacctgatgctggggtccatggtaaaacaccaagggcctgtatcggcatctggattcctgcagtagttcattgtcaggccactggaaattccaaagcaatacaagttacaggaggcggaagaatattcagggacatccagcaccctctacattttgttctaacaaagtcttaacaagtgtctttgaaatattcccattaaaggtatcatacaattgccacaacacaaatgttcctcaacttcccatttgtgcatgcctttcaaagatagatgataatttttattttaaaatatcaaaagtagtatatgcttgtattagcccgttctcacattgctatgaggaaatacccgagacagactgggtaagttacaaagaaaagagttttaattgactcacagttccacattgctggggaggcctctggaaatttacagtcatggcagaaggcaagggagaaacaggcaccttcttcacaggcggcaggacagagtaagtgcaagtaggggaaatgccagacacttacaaaaccatcagatctcaggagactctctcactgtcatgagaacagcctgggagaaactgcccccatgatccagttacctccacctggtcctgcccttgacacatggggattatcaggattatagagattacaagtcaagatgagattttgggtggggacatagccaaaccctatcaatgctccatataaaaactgagatcatacataaatgtgcaaaagaaaggaaccagaataccctccttctaccttctgccaagcacatacccctagaggaaccggtatacggattttgatgtgtgtcttatagattgttatgcatatacaaatgcgtctatacctgtctaactctctgtatctctttctacaggactgtatagtaacatgtgagttggaactaacatatatttctccaaggaggaaatgccatccaagatgatatcattcccaggccagcctcccttactctctgtactagtcgtgtagctaaaaggctctgcatttacagtgaaaaacaaccatgaaaatagcattattgtcaataccacttcaggtgggtcaagtgagtttgagtctaaaagacttataaaagctgacctggaagactaggtcccaggcaggatgctgtttctctaggatgggttcctgggcagaacctcctctcctactctcagtccatcctctactggccacagccactgcgggactgacagaagggggatgagatgaaggaacagtgggacccaaggcataaagtgagagggctggctagactatgggatctgaaaaggtccaccagctatggagggttcagaaaaacaattgagtaagtgagaggcacaggctgggtgctttggctcacgcctgtaatcccagcactttgggaagccaaggcgggtggatcacgaggtcaacagagcgagaccatcttggccaacatggcaaaaccccgtctctactaaaaatacaaaaattagctgggcgcagtggcgcacatctgtagtcccagctactcatgaagctgaggcaggagaatctcttgaaccctggagttggaggctgcaatcagccgagattgggccattacactcctgcctggcgacagagcgagactctgtcaagaaaaaaaaaaaaaaaagcacagccggtgaggaccccggtggtgggggatcttggagaatgtgctccccttcgttcctcccaggaatgttgctccaacctctcagaatcctcacattcatgacatgtggctgtctgagaaaccttgaaatgtattatgtaccgtgggaatgcaacattgtctctgtagagactctatacatgtgacccagtctcaagcccagattctccattccagcaagctggttctccaagcagctggctgtgttagcaagtatagtatatgagggaggttattgatctattttcaactgaggtatattttcatgtatagtcaaatgcacagatcttagatgtagtttgatgacttctgatgaacatgtacacttgtgtaactcacacttcaatcacaatacaggacatttacatcaccccagaaaaaaacttcgttttactgctcaatcaatctctgctactctcttcccatggccagaggcaaatgatattggtttctttcaccagaaattagttttacctttctggaaccttacatcaatagactcatacataatgttcatttttgttatctggcatctttctttaatgtaatatttttgagcatcttccatactatttgagagtatcaaaaacatgctcccttttattgctgaacagtatgccattgtatgactagttcacaaattatttattcattttcttattgattgacattgaaattgtctacagtttggggttataaaaaataaagctgctatgaatattcttggagatgtcttcgtggacttatgtttccatttctgtggggtaaatattcacaaacaggattgcaggtttgtagggtaaaagtgcatttattgaacttttggagaaactatcagactgatttcaaaagtggttgtatcattttgcactttcaccagcatatgagagagtttcacatccttgctctacatcagtgacatcagttactgtggtgtcttcttaataatatccatgtccattgggtgtttggtgacatctcatgatgattataactctttatttttcatggctgagatactggacattttttcaggtgcttattggctatgtgtacatctatctatccccaagaaatgcctattcaatctgttgcccattagttgtttgtcctctgtttagtgagtgggagaaatgttcctatattctggacacaagccatttgtcagatatatggacagagagcatttttcttctcatgtgttacttgcctatttattttcttaacaatgacttttggtaagcatgagttttcatgaaagcccacattataatttgttttattttatagtgagtgtttacagactcctgcctcaaaaaagtttgccttctccaaggttgtgaagattttatattttttcatggaactttcatatttcaggttcagttttagctctgacacttaggtggaagagatatcaaaataatttgagatgaaaagcaaaagtcaagttctgcttttgttttgtatcatggatatccaaatggttcagaatgattttgtaaaacatttttgtctccattgaattgctttgccatctatacggaaaatccatttaccatatatgtatgtgggtctggtggtgggccatccctttttaggtttgcatacttttttggccaataacacatatccttttttttttttttttttgagacagtgtctcattccatcatccaggctggaatgcagaggcatgatcaatgctcactcatggctagacctcctgagtcaagcaatcctctcacctcagcattccgagtagctgaaactacatgtgcaagtcatcacatcgatctaattgtttattttttgtagagagagggtctcactctgttgctaaggctggtcttgaacatctgggctcaagccatcctccagactcagcctcccaaaatgttggggtaacaggcatgagccaaggggccaggccaataccacatgtcttgattcctgtacttttataagtctttatattaaggtatataagtcctccaatttttttttccaaaaaaggactgttgcaatagtgcttgggtgtgggtttcatccaaagatcaatttcacgagaactgatatggagtcttttaatctataagcatggtgtatatttagatcttttaattctttcctcaacattgttttctagtgcaaggtgtatagtccttgagcatagtgtgtgaaatttatcactaaatattttttggttttgatactattgtcagtgatattgctttaaaactttaattttccaaaggatcatagcatgtatacagaaaaagtttttgcacattgagcacgtatatacttttgtttcttcaatttgaccacattcacttattagtctttaggagtgcctgcatccattaatcaccactccagcttatttatgattcaggttttcatggtatatatcctttttcatattttggtgtttaaagtagatctttacacttaaagagtatttattctaaaaagaacacacttagctgtggtttttattcaatttacaatctctgccttttatttgtaatgcttaatccttttatatttaatatactcataaggtagttcagtttgtgtctacaataatgctatgtattttctgtttacaccatatcttttatattctttattcctctttttcttccttcttttgcataaaaggactattcctcttactatccattcctctcagtttaaatttttttggttgtcctaggatttataatatcccaccttaaactatcacattcaaccatctattaatattatataacttcatggataatgcaaaaaactcattaacagtatacttccagttatcatctgcattatttgtgctactgtttttatgaattttactactacatacgttgaaacaacaatatattcctattattttaattaatatcacaaattgtcctttaaatacatttaaaaattagataaataagagtattttatattgacattgccatttgccatttccagggctcttcattacttagtatggattaaagttcccatctggtattatttttcttctacctgaataactttccttaaaatcttttaatacagaagcctgccttggaaacattcttttgtttttttgcttgtttcctctggaggtggcagaatacgtatttacatcacgtttattttaaagggtttttttgtttatttgtttgttttggctggacatgtcgtcctaggttgatctgtttttatttctctttatcactttaaagatgttatgccattgtttccaaggagaaggcatcggtcactttcattactgtccctctatgtaaatgatattgttttcctctggcttataagattatccttgttatctttgatgttggacgatttatctataatgtacccaagtaaatcatagagttttgcttttaaaaatactatttctgattcattgagcttcttgactgtgagtttatcattttcttcatacgtgtaaagtcttcagccatcattgctttgagtatttttttctgtcccaatatctccttcccgtccttctgtgacttgctttacccatatattaaatcttttgctattttcactgatatccttaaggttctatttatttttttcagcctttctctctctctctttctctctctctctctctctgtgtgtgtgtgtgtgtgcgcgcgcgcgcgtgtgcgtgtgtgtgtgtcttacagattgtatggctttcattgagttatcttctggttcactttttcttctgtaatgtataaactaatattaaggccatccagtgagtattttattaaggttatacttttttgtagttctttaatttccatttggttgttttacgcatttgcttttttttatattctgcatttgtttccctcatgttcatgttttctttaaatctttgaacacaattatcatatatacagttttaatttctttgtcaattccatcgtttctactatttcttggtctatttgtattgactggtttttctcctagttatggatcacactaattgctttttcctgcctcataaatttttaaatgatgtcactccttgtgaatgcaacattacagagcactgtaatcatgttatttacctccagtgatggttgagttttcttctgtcaggcagttaatttacttggagatcatttgggtccttttagacttggtttttaagctttactagggtgtttctggggtagtctttattctaagaaggcataaatcctactcctaaagtatgacttttctggggtctctactgaatgcccgagatgttcaatgaggtgtctctcctcgggctgatcagaaccccggtatcccccagtgctacgtgagctctggcgtcaccattgagctcactgtttccctgaatttgtcctttccccagtagtggttctctgtcccactttgtagaatttctccctgtgcatatgcagtttatattagacttccatgcatattccttcagctccttttcaccacaaattctttctcattattacctagcatagaaaatacacattttcttagctatcccaaactccagtctctttcctcagttcagcaagactgctgtggttggctttggctccaattccttgcccttcagtccaggaaggttctccaggaagaaagtcataatagttacggagttgcgctcattcatttccttttctaaattatctcagtcctgtactgtctcttgtccaacatgtggaaagtgttttttaatatcttttatagtcatttatggcagaaagccagtttttgtcagacctggttttttgtccatgtacctgcccattttaatctccatatctgtttacttcctaattctcatctacattcttgcttttgctcttcctctcctggcaacccatatcccttcagaaaactggagcttagaacccagtgtgttcacacaggtttatatatattaattatattatattatattatattatattatattatattatattatattatatgttagtgtgtgtgtgtgtgtgtgtgtgtgtgtatgtgtgtgtgtcctgcaaattgtatggctatacagcttgcagctgtgcaggctatagggtatttggtcatcagtcagggacagacataaaaaccttgcatgtttccctagaacatatatatatatatatatatgtgtgtgtatatatatatgtatatatatatgaatactagtctgtatgaacatatatatatgaacatatatatgaatactaacttatatgaacatatatatgtatatatatacatactagtctgaataaacacacctggttatatatatactcatatacatgtgaattatttacttgtgacccatgacaaaaatggcaaaaagccttcatttcagagaagggaggttagaatgatagaattgcatgggtgaaagagtgcattgatcttttatgagccttgtagaatggcactctaagtatttgatcatttgatctcttgagctttatattaaaaagacctcatcagctccatgtagccttctgcttccatcagactattagaaaagatagcaagcctaaaatacctattctctcagactctttgatcaaaagcaaagttgtctggacattttgacacaccttctgggtctaagggaaatttgtcctaacaagttagcttgaagcaaggctcttctaggaggaacttaagttggctgttgctcctcttacaagtaacatcaaagacatactcatttgggtagttttctggggtcctctgatgccggtgtggtgtcatggatgaccaagattgacatgtccttcctgtgacagtggtggagaatgtgcctcgataactctggccattaccatggtagcactgccggaccacaggggtttgctcagttggtgctgaaaatagacaaaatcaagctgagtaactactagtatgcagaaacatgtgaagcaatttatgacacaaacaggacagtagtttcagaattatgactgttctctttagtatactcacaagcagaaggacatgctgaagcaaaaacaatagattaataacattctaatattttaataagttcttagaaattttatattcaaaacctggtgggaaaaggacctatcagtgctcttacaattggaacaaagactcatgtgcaagctctttcgtatggctctctactggttgttcatgaaaacaatgaggcaggaaaccagacgatgatggattaggttatgcaggctgtatggtgattggctgtcagtaggggacagacatgaaaaccctgcacagttccctagatgattgctcctgaaaagccaaagccttaagcttctggtggacggggcagttcatggtcctgcatctagtacttggaggcaaagacacattgcttcttagagaaggatggaggctaaaatcttattcccttacagtagagacagggaatcctcttgttccagcatcctgcattgcaacaaagcagaagtctactacccttcctctcaacacacaccaaagatgcacgttccatgagaagaaggcacaagaacaccaagaaattcctgccttccaagcataggtgtgcagagcctacctaagactgaaataagccagagaaatagtgtattctgtggtatttactgccaaatagccccaggattagatggaataaatatcatcatattaggtttccccaggatgacaaactcagcggccacatacctcagcaactgcaatgctgaagattgcaatgaacactgtccattttaataaatgcctggaaacactcactagtgtgaaatttggcacaaatttggcctgatgttagaattggaattttgtctggaacaccgagataacccctttcataacaaagtgagtggtaagtcaagtgcccaggtgggtttgcaccattcctgaagtcaccgcccacgcacgttgcgccaaaaattgctccaccagagagagtgctgaggcttctttccacctgccataccctcaagtttctgtgtagcatggaaggcttctgcatcagtcagattttccatctcttttcatcccaatgttcaaatgtgtagatatctggccacagacttcttacctgcttcagaatgagcctccatgcttggaactggaacaacagtgggagtctctaggacacctgattctgtttctgagcattgtgtcagattgcagtactcccacctcacacacggatcggttgtgtaacaccagggttgtttcccagaatctggattcctgcagtagttctcggtcaggccactgcaaattccaaaacaacacaggtcacaagaggcgggaaaaaattcaggggcacccagcgctgtctaaactttgttataacaaagtgttaaaaagtgacgttgtaatattcccattttaggtacaataatattccgaaaagcaaaaacggtcctcaagttctaaagaaccatgtaaatttccaagatagattataatttttattttaaaatatcaaaattggtctatgatccataaaaaaactgagatcatacataaatgtatacaagaaaaattcggaatatcttcctccttctgccaactgcattcctccagaataaatgacatagattttgaagagtgcattttagatttttttttttttttgtgacggagtctcgctctgtcgcccagactggagtgcagtggcgcaatctcggctcactgcaaggtctgcctcctgggttcaagccattctcctgcctcagtctcctgagtagctgggactacaggcgcccgccaccacgcctggctaattttttgtatttttagtagagacagggtttcaccgtgttagccaggatggtctcaatctcctgacctcgtgatccacccacctcggcctcccaaagtgctgggattacaggtgtgagccactgcgcctggccttagatttttttaatgcacataaaaatgtattggtatctgtctcattctctgtgtctctctctaggactctgcagtaacatgtaaattgtaactgatatatattacttcagggaagaaacaacatccaacatgataccattcccaggccagcccctttatttactcacagtgtagctaaaaggctctacttttagagtgaaaagcaattatgaaaatagtattactgtaaataacataccaggtagatcaagtgtgtctggctttacaagacttataaaacctgccctaaaaaactagctcccagacaggatgccatttctctaggatgggttcctgggcaggaccacctctcctgctctcagtccatcctctgctagcggcagccactccgaaactgagggaatggaggatgagatgaaagaacagtgggacccaagtcataaagggcgatggctgggtagacaatgggatctgaagaggtcgagtggctacagaggagtcagaaaacaatggagtaagaggcacagaaagcaaggaccctggggtggagggatcttagagaatgcactcccattcatgcctcctaggaacgttgacccaacttgtcagaatcctcagattactaacctgcagctctctgagaaaacctgaaacgtattatgtgccatgggaaagtttagagactctatgcctgtgacctagtctccagcctagacccccatttgagtaagctggttctccaagcaactggatgtgctaaaaggctgagcgtttaaaagcaatttctgccctttttacagttgagatatactttcccacagagtgagatgcacagatctgcaatgttgtttttttgatgattttggatcaacacctatacctgtggagcccaaactcccatcaccacacggaacatttctgtgaccccagaaactctcttgagtccctacccaattaatctgtgctacccccttaccactgccagaggcaaatacattggtttctttcaacagaaattagtttttcctcttttggaggaaatgtaaatgatctcatgtaaatgaactcatacagaatatacatggcttctttcctgagtatatttttgagctccatccatgctatttaagatactcagtgctgaatagtattcaagtgtaccagtaggttgcaaattattttttcattttgttattgatgaacattgaaattatttttacagtttgaattataataaataaagctcctataaatattcatatagaactctttgtggacttactttttcatttccttgggataaagattcaggaatagaattgcaggtttgtaagatagaggcatattgatggaactttttaagaaaccatctgactgattttttaattcgttttatcattttgatcttccaccagcatatgataagagttttataatctacctccacatcagtgacaccacttattattatttccacccatttactttaagtttatgtgagtccttatgtcttaaatgagtctcctgaaggcagcagatggttggtgagttcttattcattctgcagttctgtatcttattattattatactttaagttctgagatacatgtgtagaatgtgtgggtttgttacataggtatacacgtgtcatggtggtttgctgcacccagcaacccatcatctacattaggtatttctcctaatccaatccctcccctagcctcaactccccaacaggcccctgtgtgtgatgttccccttcctgtgtccatgtgttctcattgttcaactcacacttatgagtgagaacatatggtgtttggttttctgttcttgtgttagtttgctgagaatgatggtttccagcttcatccatgtccctgcaaaagacatgaactcatcctgttttatggctgcatagtattccacagtgtatatgtgccacattttctttatccagtctatcattgatgggcatttcagttggttccaagtctttgctattgtgaatagtgctacaataaacatacgtgtgcatgtgtctttattgtagaatgatttataatcctttgggtatatacccagtaatgggattgctgggtcaaatggtacttctggttctagatccttgaggaatcaccgcactgtcttccacaatggttgaactaatttacactcccaccaacagtgtaaatgtgttcctctttctccacacatcctcttcagcatctgttgtttcctgactttttaatgatcgccattctaacgggcatgagatggtatctcattgtggtttcgatttgcatttctctaattaacagtgatgatgagcttttttcatgtttgtcagccacataaaggtcttcctgtcagaagtgtctgttcatatcctttgcccactttttgatggggttgttttttttttcttgtacatttgtttaagttgcttgtacattctaaacattagccctttgtcagatggctagaccacagaatttttctccataggttgctttttcactctgatgagagttttttgctgtgcagaagctctttattttaattagatctgatttgtaaattttggcttttgttgccattggttttgctgttttagtcatgaagtcttctcccatgcctatgtcctgaatggtattgcctatgttttcttctagggtttgattttttgtttttgtttttgtttttttgatggagtctcactctgttgcccaggctggagtgcagtggcacaatcttggcttgctgcaagctcaacctcctcagctcatgccattctcctgcctcagcctcccaagtagctgggactacaggtgcccacgaccacacccagctaattttttgtatttttagtagagatgggctttcactgtgttagccaagatggtctcgatctcctgacctcgtgatccatccacctcggcctcccaaagtgtcttctagggtttttatggttttaggtcttacatttaattctttaatctatcttgagttaatttgtgtataaggtgtaaggaagggatccagtttcagttttctgcatatggctagccagttttcccaacaccatttattaaatagggaatcctttccccattgcttatttttgtccagtttgtcaaagatccaatagttgtagatgtgtggtgttatttctgaggcctctgttctgttctattggtctatatatctgttttggtaccagtaccataccatgctgtttttgttactgtagccttgtagtatattttgaagtcagatagcatgatgcctccagctttgttctttttgcttaggttgtcttggatatacaggccctttttctattccatatgaaattgaaagtagttttttctaattatgtgaagaaatcaatggtagcttgatggggataacattgaatctataaatcactttgggcagtatggcaattttcacaatattgattcttccaatccattagcatggaatgtttttccatttgtttgtgtcctatcttatttccttgagcagtggtttgtagttctccttgaagaggtccttcacatcccttgtaagttggattcctaggtatattttattctctttgtagcaattgtgaatgggaattcactcaggatttggctctgtgtctcttattggtgtataggaatgcttgtgatttttgcacattgattttgtatcctgagactttgctgaagttgcttatcagcttaaggagattttgggctgagatgatagagttttctaaatatacaatcatgtcatctgcaaagagaaataatttgactccctctcttcccacttgaatacctttatttctttctcttgcctgattgccctggacagaatttccaatactatgttgaataggagtggtgagagagggcatccttgtcttgtgctggttttcaaagggaatgcttccagcttctgctcattcagtatgatattggctatgcatttgtcataagtagctcttattattttgagacatgctccatcaatacctagtttattaagagtttttagcatgattgggtattgaattttatcaaaggccttttctgcgtctattgcgataatcatacggtttttgtcattggttctgtttatgtgatggattatgtttattgatttgaatatgttgaaccagccttgcatcccagggatgaagccaacttgatcatggtggataagctttttgatgtgctgctggattcagtttgccagtattttattgaggattttcacattgatgttcatcagggatgttggcctgaaattttcttttcttgttgtgtctctgccaggttttggtatcagaatgatgctggcctcataaaatgagttaggcaggagtccctctttttctattgtgtggaatagtttcagaaggaatagtactagctcttctttgtacctctgttaggatttgactgttaatccctctggtctgggctttttttggttggtaagctattaattactgcctcgatttcagaacttgttattggtctattcagggatttgacttcttcctggtttagtcttgggagggtgtatgtgtccaggaatttatccatttcttttagattttctattttatttgcatagaggtgtttaaagtattctctgatggtagtttgtatttctgtggcatcattggtgatatcccctttattattctttattgtgtctatttgattcttctctattttcttctttattagtctggctaggcttctatgtattttgttaatcttttcaaaaaaccagctcttggatttattaattttttaaagggttttcgtgtctttatccccttcagttctgctctgatcttagttatttcttgtcttctgctagcttttgtatttgtttgctcttgcttctctggttctttgaattgtgatgttagggtgttgattttagatctttcccgctttctcctgtgggcatttagtgctataaatttccctctaaacatggctttagctgtgtaccagagattctggcacattgtgtctttgttctctttggtttctaagaacttatctacttctgccttaattttgttatttacccagtagtaattcaggagcaggttgttcagtttccatatagttgtgtggttttgagtgagtttattaatcctgagttctagtttgattgcactttggtctgagagactgtttgttatgatttccattctacggcatttgctgagaagtgttttacttccaattatgtggtcaattttagaataagtgcaatgtggtgctgagaagaatgtatattctgttgatttgtggtgtcgagttctgtagatgtctattaggtcagcttggtccagagctgaattcacgtcctgaatatccttgttaattttctgtcacgtcgatctaatattggctgtggggtgttaaagtctcccactatttttgtgtggaagtctaagtctctttgtaggtctctaagaacttgctttattaatctgggtgctcctgtattgggtgcatatataagtaggacagtcagatcttcttgttgcattgatacttttaccattaggtaatgccctcctttgtctcttttgatctttgatggtttaaagtctgtttcatcaaagactaagattgcaaccgctgctttttttttctttccatttgcttggtaaatattccttcatttctttattttgagcccatgtatgtcttttcaccctgagatgggtcttctgaacacagcaaaccaatgggtcttgactctttattcaatttcccagtctgtgtcttttaattggggcatttagcccatttacatttaaggttaatattgttatgtgtgaatttgatcctgtcattatgatgctagctggctattttgcccattagttgatgcagtttctttatagtgttgatggtgtttacaatttggtatgtttttgcagtagctgttactggtttttcctttccatatttagtgttttcttcaggacctcttgtaaggcaggcctggtgttgacaaaattcctcagcatttgcttgtttgtaaaggattttacttctcctttgttataaagcttagtttggctggatatgaaattctaggttgaaaattattttctttaagaatgttgaatattctacatctttctttggcactggatgtttcctgcccttgaacatcagactccaatttcttcagttttggaattcagactggcttttcttgctcctcagcctgcagacggcctattgtgggaccttgtgatcgtgagagaggggaggtttcaagatggccgaataggaacagctccagtccacagttcccagcatgagcaaagcagaagatgggtggtttctgcatttccagctgaggtactgggttcatctcaccggggcttgtcagacagtgggtgcagcccacggagagtgagccgaagcaaggcgggatattgcctcacccgggaagtgtaaggggtcagggaattccctttcctagccaagggaagccatgacagatgtacccggaaaatcgggacactcccaccctaatattgcacttttccaatggtcttagcaaacggcacaccaggagattatatcctgcacatggctcagagggtcccatgcccacagagccttgctcactgctagtacagcagtctgagattgaactgctagcacagtagtctgagaccgaactgcaaggcggcagcaaagctgggggaggggcgtctgccattgctgagacttgagtaggtaaacaaagcgaccaggaagctcaaactgggtggagcccaccacagctcaaggagacctgcctgcctctgtagactccacctctgggggcagggcatagctgaacaaaaggcagcagaaacttctgcagacttaaacatccctgtctgacagctttgaagagagtagtggttctcccagcagagagtttgagatctgagaatggacagactgcctcctcaagtgggtccgtgacccccgagtagcctaactgggggacacctcccagtaggggccaactgacacctcatacagctgggtgcccctctgagatgaagcttccagaggaagaatcaggcagcaacatttgctgttctgtaatatttgctgttctgcagcctccactggtaatacccaggcaaacagggactggagtggacctccagcaaactccaacagacctgcagctgagggtcctgactgttagaaggaaaactaacaaacagaaaagacatccacaccaaaaccccatctgtacatcaccatcatcaagaaccaaaggtagataaaccacaaagatggggagaaaccagagcagaacagctgaaaattctaaaaatcagggtgcctcttctcctccgaaggaacgcagctcctcacgagcaacagaacaaagctggacagagaatgactttgatgagttgagagaagaaggcttcagacgatctgtaataacaaatttctccgagctaaagaaggatgttcgaacccattgcaaagaagctaaaaaccttgaaaaagtttagatgaatggcagactaaaataaacagcatagagaagaccttaaatgatctaatggagctgaaaaccatggcacgagaactacgtgacacatgaacaagtttcagtagttgattcaatcaagtggaagaaagggtatcagtgattaaagatcaaatgaatgaaatgaagcgagaagagaagtttagagaaaaaaaggagtaaaaagaaatgaacaaagcctccaataaatatgggactatgtgaaaagaccaaatctacatctgcttggtgtacctgaaagtgacgaggagaatggaaccaagttggaaaacactcttcaggatattatccaggagaacttccccaacctacaaaggcaggccaacattcaaattcaggaaatacagagaatgccacaaaaatactcctcgagaagagtaactccaagacacataattgtcagattcaccagaaaggtcgggttacccacaaagggaagcccatcagactaacagcagatctctcagcagaaactctacaagccagaagagagtggcagccaatattcaacattcttaaagaaaagaattttcaactgagaatatcatatccagccaaactaagcttcataagtgaaggagaaataaaatcctttacagacaagcaaatgctgagagattttgtcaccaccaggcctgccttacaagagctcctgaaggaagcactaaacatggaaagaaacaatcggtatcagccactgcacaaacatgccaaattgtaaaaaccatcgatgctaggaagaaactgcatcaactaatgagcaaaataaccagcgaacatcatgatgacaggatcaaattcacacataaaaatattaaccttaaatgtaaatgggctaaatgctccaattaaaagacacagactggaaaattggataaagagtcaagatccatcagtgtgctgtattctgaagacacatctcacgtgcagagacacacataggctcaaaataaagggatggaggaagatctaccaagcaaatggaaaacaacaaaaaaagcaggggttgcaatcctagtctctgataaaacagactttaaactaacaaagatcaaaagagacaaagaaggccattacataatggtaaagggaccaatttaacaagaagagctaactatcctaaatatatatgcacccaatacaggagcacctagattcataaagcaagtccttagagacctacaaagagacttagactcccacacaataataatgggagactttaacaccccactgtcaacattagacagatcaatgagacagaaagttaacatggatatccaggaattgaactcagctctgcaccaagcagacctaatagacatctacagaactctccaccccaaatcaacagaatatacattcttctcagcaccacatcgcacttattctgaaattgaccagatagttggaagtgaggcattcctcagcaaatgtaaaagaacagaaattataacaaactgtctctcagaccacagtgcaatcaaactaggactcaggattaagaaactcattaaaaactgctcaactatatggaaactgaacaacctgcacctgagtgactactgggtatgtaacgaaatgaaggcagaaataaagatattctttgaaaccaatgacaacaaagacacaacataccagaatctctgggacacatttaaagcagtgtgtagggggagatttacagcactaaatgcccacaagagaaagcaggaaagatctaaaattgacaccctaacatcaccattaaaagaactagagaagcaagagcaaacacattaaaaagctagcagaaggcaagaaataactaagaccagagcagaactgaaggagatagagacacaaaaaaaccttcaaaacatcaatgaatccaggagctggttttttgaaaagatcaacaaaattgatagaccactagcaagactaataaagaagaaaagagagaagaatcaaatagatgcaataaaaaatgataaaggggatatcactaccaatcccacagaaatacaaactaccatcagagaatattataaacacctctgtgcaaataaactagaaaatctagaagaaatggaaaaattcctggacacatacaccctaccaagactaaaccagaaagaaattgaatccttgaatagaccaataacaggctctgaaattgaggcaataattaagagcctaccaaccaaaaaaagtccaggagagattcatagccgaattctaccacagatacaaagaggagctggtaccaattcttctgaaactattccaatcatagaaaaagagggaatcctccctaactcattttatgaggccagcatcatcctgataccaaatcctggcagagacacaacaaaaatgagaattttagaccaacatccatgatgaacattgatgcaaaaatcctcaataaaatactggcaaaccgaatccagcagcacatcaaaaagcttatccaccatgatcaagttggctttatccctgggatgcaaggctggttcaacatatgcaaatcaataaatgtaatccatcatataaacagaaccaaagacaaaaaccacatgattatctcaatagatgcagaaaaggcctttgacaaaattcaacagctctccatgctgaactctcaataaactatgtattgatgggacatatctcaaaataataagagctatttatgacaaacccatagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcagttaggaaaagaggaagttaaattgtccctgtttgcagatgacatgattgtatatttagaaaaccccatcttctcagaccaaaatctccttaagctgataagcaacttcagcaaagtctcaagatacaaaatcaatgtgcaaaaatcacaagcattcccatacatgacttcatgtcctttgtagggacatggatgaactcccattcacaattgcttcaaagagaataaaatacctaggaatccaacttacaagggatgggaaggacctcttcaaggagaactacaaaccactgcttaatgaaataaaagaggacacaaacaaatggaagaacattccatgctcatggataggaagaatcaatattgtgaaaatggccatactgcctaaggtaatttatagattcaatgccatccccatcaagctaccaatgactttcttcacagaattggaaaaaactactttaaagttcatatggaacaaaaaagagcatgcattgccaagacaatcctaagccaaaaaagcaaagctggaggcatcactctgcctgacttcaaactacattacaaggctacagtaaccaaaacagcatggtactggtaccaaaacagagatatagaccaatggaacagaacagagccctcagaaataataccacacatctacaaccatctgatctatgacaaacctgacaaaaacaagaaatagggaaaggtttccctatttaatacatggtgctgggaaaactgcctagccatatgtagaaagctgaaactggatcccttccttacaccttatataaaaattaattcaagatggattaaagacttaaatgttagacctaaaaccatataaaccctagaagaaaacctaagcaataccattcaggacataggcatgggcaaggacttcatgactaaatcaccaaaagcaatagcaacaaaagccaaaattgaccaatgggatctaattaaactaaagagcttctgcacagcaaaagaaactaccctcagaatgaacaggcaagctacagaatgggagaaaatttttacaatctacccatctgacaaagggctaatatccagaatctacaaagaacataaacaaatttacaagaaaaaaaatcaaacaaccccatcaaaaagttggcaaaggatattaacagacaattctcaaaagaaaacttttatgcagtcaagagacacatgaaaaagtgctcaccatcactggccatcagagaaatgcaaatcaaaaccacaatgagataccatctcataccagttagaatggtgatcattaaaaagtcaggaaacaacagatgctagagaggatgtggagaaataggaacatttttacactggtggtgggactgtaaactagttcaaccattgtggaagacagtgcggtgattcctcaaggatttagaactagaaataccatttgacacagccatacaattactggatatatatctaaaggattataaatcatgctgctataaagacacatgcacacatatgtttattgcggcactattcacaatagcaaagacttggaaccaacacaaacgtccatcaatggtagactggattaagaaaatgtggcacatatacaccatggaatactatgcagccataaagaaggatgacttcatgtcctttgtagggatgtggatgaagctggaaaccatcattctcagcaaactatcacaaggacagaaatccaaacaccgaatgttctcactcataggtgggaattgaacaatgagagtacatggacacagagtggggaacatcacacaccggggcctgtcatgggatggggggagtggggagggatagtattaggagatatacctaatgtaaatgaagagttaatgggtgcagcacaccaacatggcacatgtatacatatgtaacaaacctgcaccttgtgcacatgtaccctagaacttaaagtataataatagtaaaaaagaatgttgaatattggcctcccactctcttctggcttgtagagtttctgcaggaagatccactgttagtctgatggggttccctttgtgggtaacccaaactttctctctggctgccctcaacatttttttccttcatttcaaccttggtgaatctgacgattatgtgtcttcaggttgctcttcttgaggagtatctttgtggtgttctctgtatttcctgaatttgaatgtggtattctctgtatttccttaatttgaatgttggcctgtcttgctaggttggggaagttctcctggataatatcctgaagagtgttttccaacttggttccattctcccatcactttcaggtacaccaatcaaacgtaggttcaatcttttcacatagtcccatacttggaggatttgttcattccttttcattctttattccttaatcttgttttcacgctttacttcattaagttgattttcaatctctgatatcctttcttccacttgatcgattttgctattgatacttgtgtatgtgtcatgaagttctcgtgctgtgtttttcagctccctaaggtcatttatgttcttctctaaactgcttactgtagttagcaattcctctgacctttttcaaggttcttagcttccttgcattgtgttagaacatgctcctttagctcagaggagtttcttattatcttctgaaaccaggacccacttgaggaggcagtctgtcccttatcagagctctagtgctgtgttgggggatctggtgctcttttcagagctggcaggcaggaaactaagtctgctggagctgcactcacagccaccccttcctccagttgctctgtcccagggagatgggagttttatctataagcttctgactggggctgctgcctttctttcagagatgccctgcccagagaggaggaatctagagaggcactcttgctacaatggctttgccaagctgcagtgcaccctgcccagttcaaacttcctagcggttttgcttacactgtgaggggaaaacctcctactcaagccccagtatttgtggatacccctcctcccaccaagcttgagcgtcccaggtcaacttcagactgctgtgctggcagcaagaatttcaagccagtggagcttagcttgctgggctccatgggggtgggatccactgagaaagaccacttagctccctggcttcagccctttcttcacgggggtgaatggttctgtcttgctggcattccagggaccactggggtatgaaaaaaaactcctgcagctagcttagtgtctgcccaaatgccagcccagttttgggcttgaaatccagggccctggtggtgtaggcacccaagggaatctcctggtcttcaggttgcaaagaccgtgggaaaagcatagtatttgtgccagaatgcactggtcttcacggcacagtccctcacggcttcctttggctaggggagggagttccctgaccccttccacttcccaggtgaggtgacaccccaccctgcttcaggtcaccctctgtgggctgcacccactgtctaaccagtcccaatgagatgagccgggtaccttggttggaaatgcagaaatgacccaccctatgtgttgatctcacggggagcggcagactggagctgttcctattcagccatcttgccagccaccaactctttttgtatcctttaagtggagcatttaggccatttagattcaattttagcattgaaatgtgaggtgccactgcattcatcatattctttattgcctccgtactttggttttgttttttgtttttgttttttaacttgtacttttgttttataggtcctgtgtgatttatgctttaaagagattctgttttcatgtgtttctaggatttgtttcaagatttagagctccttttagcagttcttctagtggtgacttggtaatggtgaattctcttagcatttgtttgtccaaaaacgactgtatctttccttcatatatgatgcttactttcgctggatacaaaattcttgactgataattgttttgtttgaggaggctatgatagggctccaatcctttatagcttgtacagttcctgctgaaaaactggctgttaatctgatagggtttcctttatacattacctggtgcttctgtctcacagctcttaagattcttgccttcgtcttaactttgcataacctgatgagaatgtgcctaggctaagatctttttgtgatgaatttcccaggtgttctttgtgctgcttgtatttacatgttctttgtgtttcttgtatttgcatgtctaggtgtccagcaaggccaggtaagttttccccagttattcccccaaatatgttttccaagcttttagtattgtctttttcctcaggagccacgattattcttatatttggtcatttaacataatcccagacatcttgaaggctttgttcatattttcttatcctttattctttgtctttgttggattgggttaatttgaagtccttgtctttgagctctgaatttattttttctacttgttcagttctattgctgagactttccagagcatgtcacatttccaaaggtgtgtccaaagtctactgaattttttattgtttttttattaagctatctattttgttgaatatttcaccttttacttcttatacctttttttttttggatttccttgcattgggctttgcctttctctggtccctccctgattagcttaataactaacctcctgaattctctttcaggtaaatcagggatttcttcttggtttggatccattgctggtgaactgggagtgtgatgagccttgttttgtcatattaccagggttggttttctggttccttctcatttgggtagactgtgtcagagggaaggtagggctgaaggctgttgttcagatgtttttatcccatggggtgttcccttgatgtagtactctccctcttttcctatggatgtggcttcctgtgagctgaactgcagtgattattgcctgtcttctgggtcttgccacctagcaagtctacccagctctgggctggtactggggactgtctgtacagagtcctgtgatgtgaaccatctatgggtctctcagctgtggataccagtgcctgttctggtggaggtggaggagggtgcaatggactccataggggttcctagctttggtggtttaatgctctatttttgtgctggttggcctcctgcatcagctatactagtgtggagagggactagaggtgggtgggccctagaactccaaagattatatgctctttgtcttctgctaccagggtgggtagggaaggaccatcagttgggggtgggactaggcgtgtctgagctcagactttccttgggcacgtcttactgaagcttctgtatggtgtgggggtgaagttcccaggtcactggagttgtgtacctaggaggattatggctgcctctgctgagtcatctgagttgtcggggaagtggagggaagctgtcagtcacaggcctcacccagcacccatgcaaactgaagggctggtcttactcccaccatgcccccaaccccgcaacagctccaagtctgtttccaggtggggggaaagtcaggcttgaaaacttgcctgaggctttccacctcccagctgtgaaagaaaagggctttagtccttcccccacctgtgaagtctgcaaaccagattcatgccctcccccaagttctggccaggaggcttctccccctgttcaaattgttagaaagttcaggtagagcagtcctccatgtggagttttaccctctgttcctttggccacacttctgatggatctctgtggtgccaggcaggaatgagctgcttggggatccagcaagctctgaggtcttctctgctgcttcctctacccctatattttgcttggctcagctctctaaatttactgaggcccaggtaaagttgggaacttctcctgcaaacagactttcagcttctccagttgtggggtgtgtttgagggagtaaggcctcccttttccacttctgcagttggggaactcacagtatttggggtgtctcccttatcctgcaggagcagtctgcttccttcacacggtctgtgggtcctctcaggattgctggtctgttcttgcagtcaatatggggctaaaattcacaatatgagcctctgcatgctgctctgtccagagctgcaatctagtcctgcctcctgtctgccacgatccctcacctcttgggtttttcttctattactttaaagatgttactttattgtttctgactttcattgtttctgatgagaaggcatcagtcatttgtgtaactgttcctttatataaacaatcttttttcctctggcttataaaattttcctagctttctttgattttagacaatttaaccaagaagatttgccaaagtaaatcatacatttttacttttcaaaatcatatttctgattgattagttttcttgaatctgtgagcttttttttcttcatatttggaaagttttcagccatcattgcttcaggcattttttctgttcaagtatctctttcttctcttgtgatatctgatcacaagatcaaatgatcatatgtatattttaaatgtttttgctaattctatcatttctgtcatttctgggtctatttgtattgaatgatttttctcctggttatggatcacactaaatgcttcttgtatgtctagtaaatttttaaatttatgtcacatattgtggatgccagataactgagcaatttgattttattgtttacctatgaagaggttaagctttcttctgatgggcaactaatttatgttgagaggattttggtctttctgacttgcttttcaattttgctaggatttttgtggagtagattttgctcttaaaatacatcaactctgtttccaaagagtggcttttctggggtctctactgaatgcccaagatttgcaatgaggtctcttttctagctggtaagaactcaaatatcccccagtgctttgtgagctctgccatctccattgaactcattgttcccttgtagttattctttccccagtagctgttctttgtcctactttcattgtggaatcactccctgtgcatatgcagatttatattacactgaggtgacttctaggtacatgactgtagctctttatctccacaaattctttctcattattaccaagtgtagaaaatcccagctgcctttgtaatcccaaactctggtgtctctcagttcatcaagactgctgtggtcttcttgggctccatctctttttccttcaatccatgatgaaatacagcacacttatggggttgatcacatttgttttctgttctaaattatctcaatacactactatctgttgtgcaacttgtgaaaacagtattttcatatattttatagtcatttacttccaaaaggctgttatgcttatacctgctttttgtccatgtacttgtccattttacttttcagcgtttgtgtacctcctgactctcatccgccttcctgcttttgctcttcaagtcctggcaacacatgtcctttcagaccactggtgcttcaggcccagtgtgtttatacctgtatgtatgtgtgtgtgtgtgtgtgtgtatatatatatatatatatatatatacatatatatatatatatatatatgtatatatatatatatatatatatatgggtatatatatatatacacacatgcacacatatatttgtgtgtgtaaatgaatattcagttacatacctgaatatttatatataaatatttaaaatgttatattaaaatatataaaaatactcagacatacatagtgaaacaatataatttttaatgaaatattaaaaatatataaatttatgcaaaaatttaaatataagttttatacacaagtatataaatattcagacatatatataaatattcagatgtttgtgtgtgtgtgtgtgtgtgtatatatatatatatatatatatatatacacatcttaatttttttttttttacttattacccatgacaaaaatggcaaacaaaccttcgggaattgaaatttagaatgacagaattgcacgagtgaaagatgacattgatttttagtgggcattgtggaatggtgctgtgtttaagctttggtcatttatcttctgagctttacattaatatgacttcgccacttccgtatattctactccttccataaaactattaggaaaaatagcaggcctaaaatttctcttctcttagactctttgctcaaaagcaaaggtcctgagacattttgccaaaatgtgagtctaagagaaatttgtccctaggaagtgagcttaaagcatgggtcttctaaccaatatttgagttggctgttgctcctcttatggttttaatcaaatacatacgcatttgggtagttttctggggtcctctgatgccagtgtggtatcatagatgaccaagattgacaggtccttcctgtgacagtggtggaggatatgcctcgataactccgtccatcaccatggtagcaatcctggaccacagggcttttctcaggtggtgctgaaattaaaataaaataaatcatactcagtaattgcatgagcagagaaacatgggagacaatttatgtcacatactggacagtagcctctgaaaattattactattcttttttctactagtagcaaaaggatgtgaaaagacccagtagattcatagtattctagaattttaataagttcatagaaacattatttttaaatctaaagataaagaacagaggagaatgctggacattggaaattacattcatgtgcagctccatcatatgaatctctgctggttttcatgagaaccacagggcagaagaccagaatgcaatgcattccttggtgcaggctgtaggaggtgactggtggtcagtcaggggccgacacaagacccttgcgcatttccctagaccattgctcataccaaggcaaaaggcttaatcttttgaaaatttgggcaggaaatcatcctacatttaggagtgcaggcaaagactcattgtttctcaaggagggttagagacaaacaacttattcccttggaggagagatagggaatcttctagtgcccagagtcctgaattgtaacaaagcagaattctcttcctcttcttctgtagactcactgccaatgcaggtttcatgagaagaagaggcaagaacacctagaaatttctaacttcaaagctgaggtgaacagagcctgtgaaagactgagataggccagggagagacagcattcgttggttacctcctgctatgcagccccaggacaatagaaaaataatgcagtctccttaggtttctctaggatatcatactcaaaggccatgttcttaagaaactgcaaactgtagattgcaatgaaaaaagtctactttaaatcactggaaaggcttattggcttggaaatcttcacatatttggcaggctgttagaatatccattttggctaggacactgaaatgacccatttaataaccaggggagtggtaagtccagtgccctggcgggtctgtgcccttcctaaagacaccgtgcccttcctaaagacactgcctcctcacagcgtgccaaaaatcacagttctggatcccccagagagggcgctgaggctttcctccacattgcagaccctcaaccaaccctccagtgtaccactgaaggcttctgcatcagtaagattttccatggtttttcatcccagtatatagatgtctaaccacaaatttcttaccttgttcagaaggagcctctgtgcttggaaccggggccactgtgggagttgtgaggacactcgattctgtcactggacatcgtgtcaggttgcagtactcccacctgacactgggatccatggtgtaacaccaagggcgaatctcagcatctggattcctgcagtagttcctggtcaggccactgcaaatttcaaaacaacacaggtcaccagagatgggagaatattcaagggcacttagcgccctctacattttgctgtaacaaagtgttaacaagtgcctttgaaatattcccattataccacaataatattgccacaagcacaaatggtcttcagcttcaacttttaaacaactgtggacacatcacagattataatttttgttttaaaacatcaaaagtagtatatgctctctatgaaaactgagataatacatgtctgtacaagaaaggatcagaatatcttcctttcaccttctgccaaatactttcctccagaataaatgacacagattttgaaatatgtatcttagattttttaatgcacatacaaagatatctctgtctgtctagctctttgtctctctctctataagactatatagtaatatgtaagttggaactcaaatacatttccccaaggaagaagtggcatccaagattatataattcccatgccagcccccttactctatttactcatagtgtagcataaatgctctacatttgcaatataaaataatcatgaaaatagtattactataaatactgtatctggtagagcaagtgggtttgggtctacaggacttataaaagcttccctggaaaactagctcccaggcaggatgctgcttctctaggatgggttcatgggcacgacctcctctcctgctctcagtccatcctctgctggctgcagccactctgggactgaaggaatgggtgatgagttgaaagaacagcgggacccaaggcataaagggagacggctaggtagactatgggatctgaaggggtcaagtggctatggatgagtcagaaaacaatgcagtaagaggcacagcaggtgaagaccccaggctggaggaatcttggagaatgccttccccattatgcctcccaagaacgttgctccaacctctcagaatcctcacattcatgacctgtggctgtctgagaaaacttggaacgtattatggagcatgggaatccaacacggtctctgtagagactctacacatgtgacctagtctcaagcccagatcccccatttgaggatgttaggcagtggtttttaacacaactggacgtatcaagtgatgtagcacctgaaacagatacctgctctgtttttcagttgagtatattttcacatagagtgagatgcacagatcttaaatgtagctggatgagatttgataaatacatatacttgtgtagcccacactgccctcacaatgcagaacattttcaccaccccagaaactcccttgtgtggctgctcaatcaatctctgctaccctcttcccacggccagtgtcaaatgctattggtttctttcaccataaattgtgttttctataaactcacatgaatggactcatacagactatacactttgacgtctggcttctttccttaatatatttttgaggtttgttcatgcttctgagactatcagtaacttgttccttgttgatgaatagtattcctttgtataaatatactggaaattcttttttcattttcttttgatgaaaccatttaaatagttttcattttcttttgatgaaaacattgaaatagtttttattttgagtttataaaacataaagctgctatgaatatttatatagatttttgtggacttatgttttcattttggggggtaaatattcaagaatagaattacaggtttgtaggatagatgcatatttatcgaactttataagaaagcatcagactgattttttaatttgttgtatgattttgaacttccaccagcatatgagagagtggcacattctagctccaaatcggtgacaccacttattattgtgtcttcttaatgatatccatgtacactggatgttcagtgtcatcttatgagggttataactcttgatttttgatggctaagatgttgtgcactttttcaggtgattgttggctctgtgtgcatcttctcctaagaaatgactattcaagcctgttgcccattttgattaggttgtttgtcctctgattagtgagtgggagaaatgtttctatactctggatacaggccatttgtcagatatatggatgagagtgtttttcttccagtgtgttacttacttatttattttcttaacagtcatatttggtgagcataagtttttattcaatgaatgtccacattatcatttgttttcttttacagttagtgttttctggttcttccctcaaaaaatttttccttctccaaggttataagatactatactttttcatagcagtcttatatttcagcctcagaattagctgttacattgaggtctaagagctatctcaaattaatttaatttgagtcatacagtaggattcaagcgtcacatttgttatagtttttttctatggctatccagttgtttcagaccaattttggaaaaaaatttcctcattaaattgctttgctacctgtattgaaaataaattgaccatatatgtaaatttatgctgacccttttctgtttttgtttgcatatgttttgcccaatactatgtattttttgtttgtttgtttgagagagagagggaaggttttaatctgtctcccaggctaaagttcagtagcacaatcatggctcatttcagcctccacctcatgggctccagtgatcctcccacctcagcttcctgaatagctgggactacaggcacatggcaccaaacctggctaatttttttaaatatttgtagagatgagggtcttgctatgttgcccaggcttgtctgcaactcctcatctcaggcaatcctctcatcttggcctcccaaagtgttaggattacagccaagcgtcccagccaataccacatgtcttgattactgtgtctttatgagaatttccatattaccatatgcatctatcccacaaacttgtgattttattccaagttttttattctttttaaagattgtcttggtgattctagcatatacattctgttaggttttcaagaaaagactgcaggaattctgcttgggtgtgggttgaaactaaagatcagttttgtgaaaagtgacattggattttttaatctataagcatgatgtgtctttatttagatcttctaattttcttctcaccaatgttatgtagtatacatggtatagttcttttgcatattgtgttaaatttatcaataaagtttttttgttttgatagtattttgtggttttgatgccaattcccatatggtattatttttcttctacttacatagcattctttcacatcttttattacataatcctgctgatgaaacattcttttatttgttctttgtttttaggaggacagaatatgtacttacgtaacattcattttcagtggaattgtttgctgtgcatagcgtttaagcttgctgggtttttttccttcttttcactctaaaggtgttattccattgtttctgacttgatctttttttttcttcttagcatattattccattttttctgacctgatcttttcttcttcttactactctaaaggtgttatttcattgtttctgattttatcttgttttccttcttaccactctgaaggcgttattctgttgttcctgatttgatctttttttctttcttacactctaaaggtgttattccattgtttctgatttgatcttgttttcctccttaccactctaaacgtgttattttgttgtttctgatttgatctttttttcttcttaccactctaaaggtgttattctattgtttctgatttgtgttgtttctgatgagaaggcatcagtcatttgtgtcactgttactctatgtaaaggtatgttttttcccttgggcttcaaataagattttactttctatctttgattatggacaatttaattatgatgtgtccaaataaatcatacagctttactttttaaaatcctatatctgatccattgagcttcttgactatgtgagtttatcattttttccatatttagaaagtcatcagccatcactgcttcaagtattttttctgttccaatatctctttcccttcctctgtgacttgctttaaacaaatattaaatattttgatattttcatagatgtccttgaggctctgtttatcttctcaggctttgtataagcgtgctatggtttgcaccaccctaatattttctagttagctttatcatctgtactatctaatatgattataaggccatgtagtgattttctcattaaagagatgtcttttttttcagttcttgactctccatttggtccttttacaatttttctttctgttgatattatccatttatttatttcttgtccacgctttctttaaatccttgaacacaattatgatacatacattttaaatctccttgccaattctgttatttttatcatttttgggtctatttgtattgactgatttttctcctggttatgggtcacactaaatgctttttgtatgtttagcaaatttttaaatgtatgccacacattgtgcatactatataattgagcaatttaattttgttgtttacctctgaagaggttgttttcttctgacaggcaattaatttacttggagatcatttggatctttttagacttggtttctaagcttttctagggtgtttctggagtagactttattctaggaatgcattaattctactcctgaagtatggttttttggggtctttgctgaatgcccaagatgttcaatgaagtgtctctcctcaggctggtcagagctcaaatacctcccagtgctatgtgagctctggcatcttcattgagctcactgttccccagcagttgttctttccccagtagctgttctttgttctcctttctctctggaaactctttctgtgcatacacagctttctgttcagccagagacttgaagagacttctgtgtgtattcctggagctccttttctccacaaatactttctcattattacctaacctagaaaatctcggttttattagtaaacaaaactccagtctctctccccagtttagcaagactgctgtggaatgctttggttaaaactctttgcccttaagtctaggaagggtaattatggggttgatcttatttgtttccctttctaaactatctcaggttgtactgtctgctgttcaacatgtgcaaacagtttttccatattattcatactcacttatggcaagaggccagtttttgtcagacatgcatttttttgtccatgtacctgcccattttaatcaccacatctgtttacttcctgactctcatctgcattcctgcttttactctgcctgacaacccatatcccttcagaaaactggtgcttagaacccagtgtgttcatacaggctagtactcatatataaatatatgcactcatttctattttcttcttcttcttcttcttcttcttcttcttcttcttcttcttcttcttcttcttcttcttcttcttcctcctcctcctcctcctcctcttcctcttcctcttcttcttcttcttcttcttcctcttcttcttcttcctcttcttcttttcttcttcttcttctttttttttttttttgagattgagtcttgctctgtcacccaggctggagtgcagtggcatgttctcggctcacagcaaactctgaatcccaggctcaagtgtttctcctgcctcagcctcccaagtagttggaattacaggtacccaccaccatgaccggctaattttttaatttttcgtagagatggggttttgccatgttagccaggctggtcttgaactcctgacctctggtgatctgcccgtcttgtcctcccaaagtgttgggatcacaggcctgagccactgcacccagcctgaatttgttacttctgattcgtgtcaaaaatggcaaacacaaatttcacttcagggaatggaggatagaatgatagaattgcatggttgaaagactgcatggacctttagtgggcattgtggaatgatactttgtctcagcatttggtcatttgatctccttagctttacattaatgagacttcaccacctccatatatcctgctgcttccatcaaattgttatgaaagatagcaatcctaaaacttctcttcattcagaccttttgctcaaaagtaagtttcctgagacattttgctacaaactctgagtctatgagaaatttggacctaggaagtgagcttgtagcatgggccagctaagagaaattttagttgactattgttccttttatggctaacatgatagacatacgcatttggatagtataatgggatcctccgatgccaatgtggtgtcatagacgaccaagactgacatgttcttcctgtgatagtggtggagagtgtgcctcgataactctgtccatcacctcggtagcagtcctggaccccagtgctgttttcagttggtgctgaaattaaaagagaaaatcaagctcagtattgcctagaaaagggaaatgtgaaaaaaattatgacacacaaagtggaataatctgaggattaacaatttacactcttctatattagcatgcaaattgaaatgtagaataaaaatacaaatagacttataggattctagaaatttaataagtagtcataaatattttaattcaaccctggaaaacaaacaaacaaagaaacaaacaaaaaacagatcagagtgcctatacttcaaaattacactcatgtgaatggtcttttgcttacacctcttctgggtgttcatgagaacaaggcaggagaccagggtgccatgcatcaagctgttcaggctataggtggtgattggctgttagtggggggtatacatgaaacccttgcacactagaccactgctcctccaaagcaaaagccttcagattctggggtgtggggcagaaaaggatcttgcatctaggacttgtaggtaaagacacattgcctctcagggagaaggagtacaggccaaaattttatagcctaggaggggagacagggaatcttgggcccaggatccctcattacaagaaagctgacatccactactcttcttctcaaaaaacaacggagataaatgttccatgagaagcagggatgagaacactgagaaatcccttccctcaaatcctaggtgtggaaggcatgcccaagatgaaggtaggctggggagataaacaatttggtggctatgtactgcttcaaagtctcaggacaatacggatctaatgaagacatgttaggtttctcaagaacaacagcctcaaaaatggcattccttcaaaatggtaaagctgaagactgcaataaacactgcctacttgaagaaagggctggacaggcttaggagcttggtatatcttcacaagtttggcaggatgttagaatatccatcttggctaggacactaatatgattcgtttgataacagggaagtgataaatccagtgtcctagagggtctgtgccccttttaaagacaccatccctcacaaggcactcaacatcccagctctggtccccccagagaaggcactgaagcttccttcccattggctgtccatgacttcaccttcgacttcctgtgcagcatggaagttttctgcatcacaaagattttgcaaatctttttatcccaatgtccgagggtatggttgtctgactgcaggcttcttaccttcttcagaaggaagctctgtgcttggaactgggaccaccgtgggagttgtgaggagagttgattccatcactggacattgcgtcaggttgcagtactcccatctgacactgggatccatggtataacaccaagggcgaatctcagcatctggattcctgcagtagttcctggtcaggccactgcaaattccaaaacaatacaggtcaccagagattggagaagatacagcaccacctggcaccctctatgttttcttgtaacaaagtgtaaacaagcaaatttgaaatattctcactaaagtcccataacactcacaaatggtcctcaacttctaaacaactgtcaacatttcaaagacagcttatgattcttattgtaacacattcaaagtaatctatgctttataagaaaactgagagaaaacatcaatgtgtaccagaaaggatcagaataccctccttctaccttctgccaaatacattcctttggattaaccgagagggattttgaagtgtgtcttggagattgtttcacgtacatacaaatgtttatctgtcaggctgtctgtaagtctctataaaactgcatgatctattcagtgtttgatttgctgatttgttatttacctaagcaatccatccacatgatctacattcatgaatttatttacatacagttgatctcaatatctacttctcagctttcacacctggaggatgctatagcaatggcatctctctcctgttactcatgatggtgatggatatgctccctccttggtctgtcatctgtttagccagactttggccaatcatatagacttttcaaagaacctaactttctgtttcatggatttactcctttgttggtctattttcttttccactgaatgtcattggtttggactatttccttccatcctctttccttgtgccttatttgcttttccttgcctagatatttaagctgtggtcttagatcaacagctgtcaaagctgttgttcataggaaccccctttttttctttttagctttgaattgaggcaacttaactatgatatatcccagtaaatcatagagttttgctctttaaaattctatacctgagtcatttagcttcttgactatgagtttcttgttttctgtatatttggcgtgttgcgagccatcatcgcttcaagtataatgtctgtcatgatatctttttcttctccttctgtgacttgcctaacacatatattaaatgtgtggatttttcctagatgcccttgaggctctgttgattaataggttcagtctttgtgtgtgtgtgtgtgtgtgtgtgtgtgtgtgtgtgtgtgtgtgtgtgtttctgtctgttggtctgtctgtctgtcctgtgatttgtgtagctcctattgaattattttctaggtcacctttcctaccgtaatgtctaaagtgatgataaggccatccagtgagttcttcattagagatgtaccttttctcagttctttaattttcatttggctctccggttcttttcttttctcttgctattctgcttttgtttctctcatggtcagcttttgctgacattttcctgaaacacagttctcagaggtgcattttaaatgttctcaccaatgtcatcaattctataatttctgggcctgtttgtgttgagtgattttttctcccagttatgtatcacagtgaaagcttcttgtgtctctattaaatttttaaatagaagtaacgcaataggaatgccatataactgagcaacttgtatttgtcccttgcctctaaggggggttgagttttttttttcttgtggaatgcagttaatttacttggagatcatttggatccttttagactggcttggaagaagggttgttggagtttttctggagtcaccttgattctaggaataagatgatcccaatcccaaaatacagctttctttggtctctactgaatgcccaaaatgtagtgaggtgtttctcctctgagtggtcagaattcaaatatcccccagtgctatgtgagctctggcatctccattgagcttactgttcccctgcagttgttctttcccaagtagcttttctttgttgttctttctttatgaaaactctccctgtgcatacgcagctttgtatttagccaaagccttgaggagacttctgtgtgtattcctggagctcctttcttccacaaatcccttctcattcttagccagcctagaacacatcagctgcctgaggcatcgcagactccagtctctctcctcagttaagcaagactgctgtggtcagctgggctccatctgcttgtccttcaatccaacactgtgtccaggaaggaagacaggttaatgatgaagttgatctcctttgattccctttctcagttctctcaagcctaccatatctgttgtccaacctgtgaaaactgttttctcatgtatttgatagtccttcatggcagaaaggctggcatagccagacatgggtttctgtccatcttcctgaatgtgtaactcttcagcatctctatacttcctgactctcagctgccttcctccttttgcccctcatgggctggcaacacatagcttttcagacaccttgttctcagaacccaatgtgtttatacaggttagaggagaaagtgatcggaagatctcgaagtcaatatagatatccttcacttgttacccaagacaaacatggcaaacacaaccttcactccagggcttggagattagaatgacagaattccctggttgaactatttcactggtctttagtgggcattgtggaatggtgctatttctaagcacatggtcatatgttcttctgagctttctattcatgagacctcaccacctccaagtatcctcctacttctatcaactatgagaaaagagagctggcctgacatttctctcctctcagaccctgtgcccaaagcaagaagcctgagacattctgtccaacattctgggtctgagagaaattgggtcataagaagttagctggaagcatggctcttccaggagaaatttaagtgggtggctgtttctcttgggagaaaactcaaagacatacccatttgggtagtattctgtggttctctgatgccagtgtggtgtcatagaggaccaagactgacatgtccttcctgtaacagtggtggagaatgagcctcgataactctgtccatcaccatggtagcagtcctggactgtggggctttgctccgttggtgctgaaattcaaagaggagaaaacaaactgagtaatttccagaacacagaagcatgagaaaaaaaatccatgatagaaacaggacatcatctctgaaaatgacgaccatgctctgttctacattagtaggcagatggacatgccaataacaaagctcaaagattcatagcattctggaacttcaatgagtttttagaaagattttctttaaaacctgggcaccaaaggacagatcagagtgcctatcagtcaaaattgcactcatgtgcctgttctttggcaaagatctcttttgggtgttcctgagaacaaggcaggagaccagagtgccatgcatcaggcggtgcaggctgtaggtggtggttgtcagtgggggcagacatgaaaccgtcacacatttctccagagcactgatcctccaaagccaaagccttaagtttctggaagatggggcaggaagtggtcctccatctaggacttccaggcaaagacacattgtctctcagagaggggtactggccaaaattttattcccttggagggacggcgggaaatcttgggcccaggatcctgcattgcaacaaagtagacatccactactcttcttcacaaacagcaacacagatacgtgttccatgagaaggaggggcaagaacactaagaaatcccttccatcaaagcctaggtgtgcagcacctgcctaagattaaggtagacagggagatagagcatttgctggctatgtactgttacctagacccaggaggatatggaactaagtaaagtcatatcaggtttctcaaggatgacagactcaaaaaccacattcctctgaaactgtaaagctgaagtttgcaatgagtactgtctacttgaagaaataccaggaaaggctcatgatgagcttggtaaatcatcacaaatttggcaggatgttagaatatccattttcactaggacactgaaataatctattgaataaccaggggagtggtaaatccagtgccctagaaggtctgcacgcttcctaaagacaccaccctgtcacggggtgccaaaaatctcagccctggttcccccagagaaggcgctgaggcttccttcccattggctgaccctgagtccacattcagattcccgtgcagcatggaaggcttctgtatcactaagattttgcaactctttttatcccaacgtccaagggtgtggttgtctggccagagacttcttaccttgttcagaaacagccgtggacgtcgcaaggacacttgattctgtcactggacattgtgtcaggttgcagtactcccatctgacattgggatccatggtataacaccaaggactaatctcagcatctggattcctgcagtagttcctggtcaggccactgcaaattacaaaacaatacagttcaccagagatgggagaagatacaagggcaccagacatcctctacattttgttgtaacaaagtggtaaaaagtgactttgaaatattctcactaaaggtcctgtaacaatcacaaatcgtcctcaacttctaaacaactgtgaacatttcaaagacagattatcattcttattgtaacacatccaaactcgtctatactccataagaaaaccgagagaaaacatcaatgtgtacaagaaaggatcagaataccctccttccaccttctgccaaatatgttactttggattaactgagagattttgaagtgagtcttgtagattgttttatgcacgtacaaatgtttctctgtctggctatctgtatgtctttctataggagtacccaatctattcagtatctggtttgctgatttgttgtttacctaaggaattgatccacatgatctacattcatgaatttattcacatacagtttttcttgatatcttcttgtcagctttcagacctggagtatggtatagcaatggctcctctcccctgttacttcaaatggtgatggttgtactccctccttggtctgtcatctgttcagccagactgtggtcaatcacatgaatcttttcaaagaaccaactttctgtttcatggatttactcctttgttggtctattttcttgttcactgaatgtcattggtttggactatttccatccatcccctttccttgtgtcttatttgcttttccttgcctagatatttaagctgtggtcttagatcaactgtcaaaatgtttgttcataggaaccccctttttttcttcttagctttgaaatcagacaatttaactatgatgtaccccagtaaatcagagttttgctctttaaaaatctatacctgagtcattgagcttcatgactatgaatttctcattttctgtatgtttggaaatttgtcagccgtcatggcttcaagtataacttctgtcacattatctttttcctctctttctgtgacttgcctaacacatatattaaatgtgtggatgttttcctagatgtccttgaggctctgttgattaattggttcagtcattgtgtgtatgtgtatttgtgtctgtctgtctgtcttgtggtttgtctagctttaattgaatcattttctcgttcaccttttcctaccataatatctaaactggttataaggccatccagtgaattcctcattacagatataacttttctcagtttttaaatttccatttggctcttcaattcttttcttttctgatattatgcattcatttctctcatggtcagcttttgctgacattttcctgaaacacagttctcagaggtgcattttaaatgttcttgccaatgccataatttctattatttctgggcctatttgtgttgagtgatttttctcccagttatggatcacagtgaaaacttcttttgtgtctagtaaatttttaaatgcaagttgcactctggggatgtcatataactgagaaacttgtattcgttccttacctctaaggagggttgagtttacttttttctggaaggcagttaatttacttggaaatcatttggatccttttagactggcttggaagaagggttgctggagtgtttctggagtcaccttatttctaggaatccgaagatcctactcccaaattatggctttctttgacctctactgaatgcccaagatgttcagtgaggtgtctctcctctgagtggtcagaactcaaatatcccccagtgctatgtgagctctagcatctccattgagctcactgttcccttgcagttgttctttccccagtagcttttctttattgttctttctttgtgaaaactctccttgtgcatacgcagctttgtatttagccaaagccttgagaagacttcggtgtgtattcttggagctcctttcctccacaaatcccctctcattcttagccagcctagaatacgtcagatgcctgaggcatcacaaactccagtctctctcctcagttaagcaagactgctgtggtcagctgggctccatctgcttgcccttcaagggtctcaaggaaggatgccagggacatgataaggttgatctcctttgattccctttctgaattttctcaggcctgtcatgtctgttgtccaacctatgaaaacacttttcctatgtatttgatagtccttcatggcagaaacgctgacgtggtctgaactgggtttctgtccatcttcctgcatgtgtaactcttcagaatctttatacttcctgactctcagctgccttcctacttttgcccctcatgtgctggcaacacatagctcttcagataccttgttctcagaacccaggtacaggttagaggagaaagtgattggaagatctggatgtcaacatagatatcctttatttgttgcccaagatgaacatggctaatacaaccttcacttcaggacttggagattagaatgacagaaatccctggttgaactattgcattggtctttagtgggcattgtggaatggtgctatttctaagcacgtggccatgtgtcctgagctttctattcatgagaactcaccaccttcaaatatcctcctgcttctgtcaactatgagaaaagagagctggcctgacatttctctcctttcagacactgtgcctgaagaaagaagcctgagacattctacccaacattccagatctgagataaatttgtcataagaagttagttggaagcatggcccttccaagagaaatgtaagggggctgctgtctgtctttgaagaaaactcaaggttgtacccatttggataatattctgttgtcctctgatgccagtgtggtgtcatagaggaccaagactgacatgtccttcctgtgacagtggtagagaatgagcctcgataactctgtccatcaccatggtagcaatcctggaccccggggctttgctccgttggtgctgaaattcaaagaggagaaatcaagctgagtaatttctagaacacagaagcatcagaagaaatctgtgactgaaacaggatcattgtctctgagaaagactaccatgctctgttctgtactagcaggcagatggacataccaataataaaacccaaagattcatagcattctagaactttaacgagttcttagaaagatttcctttaaaacacaggcaccaaaggaaagatcagagtgcctatcagtcaaaattgcactcatgtgcatgctctttaatatagacatcttctgggtgttcctgagaataaggcaggaaactagactgctatgcatcaggctgtgcaggttgtaggtggtgattgactgtcagtggggacagacatgaaaccgtcacacatttccctagactgctgatcctccaaagccaaagccttcagcttcttgaagatggggcaggaagcggtcctgcatctaggactcgtaggcaaagacaaattgtctctcagagagggctactggccaaaattttattcccttggagggatggctggtatctttggcccaggattctgcattgcaacaaagtagatatccactactcttcttctcagagaccaacacagatatatgttccatgagaaggaggggcaagaacactgagagatccctcccatcaaagcctagttgtgcaggactggcttaagatggagataggccagaacgatggagcatttgttggctatgtactgctacctggacccagaagtatatggaactaagaaaagtcatattaggtttctcaaggatgacagactcaaaaaccgcattcctccgaaaccgcaaagccaaagatgcaatgaacactgactacttgaagaaataccatgaaaggcttatcatgagcttggtaaatcttcacaaatttggcaaaatgttagaatattcttctggctaagacactaaaatgatcctttgaataaccaggggagtggtaagtccagtgccctagagggtctgcacccttcctatagataccaccctttcacagggtaccaaacatcacagctctggttctcccagagaaggcgctgagtgttccttcccagtggctgaccctgagtccacattctacttggaattgtgtgagcatggaaggcttctatatcactaagattttgcaactcttttcatcccaacgtcctagggtgtggttgtctggccatagacttcctaccttcttcagaagaagcctctgtgcttggatctgggaccaccgtgagagttgcaaggacacttgattctgtcaccaggcattgtgtcaggttgcagtactcccacctgacactgggatccatggtgtaacaccaagggcgaatctcagcatctggattcctgcagtagttcctggtcaggccactgcaaatttcaaaacaacacaggtcaccagagatgggagaagattcaagggcacttagcgccctctacattttgctgtaacaaagtgtaaaaagagactttgaaatattttcactaaaggtcccataatatgcacaaatggtcctcaacttctaaacaactgcgaacatctcaaagacaaattatcattcatattgtaacacatccaaagtcatctgtgctccataagaaaattgagagtaaacatcaatgtttactctgtacattgtgcaagttgcacttgtacttgtacaacttcaattgtacttgtacaattatactctgtacattgtacaatgttgtacaatgtacaagaggatcagaataccctccttccaccttctgtgaaatatgttcctccagattaactgagattgattttgaagtgtgtcttgtagattgttttatgcacatacaaatatttctctgtcagcctctctgtatgtctctctacaggactacactaactattcagcatctggtttgctgatttgttgtcttcctcaggaattggcccacatgattaacattcctgaatttattcacatacaattgttctcaaaatcttcttttcagctttcagaactggaagatgctatagtaatggcacctctcctctgttactccagatggtgatggttgtgcaccctcattggtctgtcatttgtttagccagactgtgttcaatcatatggatcttttcaaagaatcaactttctgtttcaagagtttactcccttgttggtctcttttcttgttcactgaatgtcactggtttggactacttccttccatctgctttccttggctcttatttgctttttttttttttcttgtgtagatatttaagctgtggtcttagatcaacaactgtcaaagtctttgttcataggggattccaaagagcttttctttttcaaaacacaagatgaatatttatagtataagaaaccaacactgagaatttttttaacacacaaagtcaacaattgcccattttcttagccatcagagacatgatgccattacatattatgtaactgctggaaaactcccctcttctcttgttggaaaatgaaagtaaaaagggccaatagcatcttacttttcacgtagcaaagtcctttaacctcatggactgtctctgaaggtactcaaaggtcctcaggtttctctagactacactttgagaattgcagtttgaaatcttgattattacatgcttctgtttttccctaagagcatctaaaattatgtaaaagcctaaagacattcactgcatctcctaagtttggataaattgtgttatattcttactcagttcaaaacttttctaaattccttagtgatgttttctttgtcccaaagagtattttgaaatgcaccgtatgactcccaaatatttgagaagctggcaaacttctcattattcatatctcactttattctgggagaataaagtgacacactctgtatgactttaattcttttaaatctatggagacttgctggaaggtcatgtgtagagtacacctcagtgaatgctccatgcacactttaatgtgtactcggtagttcggtataatgttaaataggtcgacgtttttattgagaacaaagatactatgtctaattttctgcatatttgttctagcctgttgtgtttgggaaagatttataaccatagtgagagaatcaaggaaatctctaactcagagtgtgggcttatctatttctctcttcagttgtgtcagtttttcaatcatacatcacaaaagctcttattagggtaaaacacattgagcattgctacatattcctcaatgaacaatttttacttctctatgtttcaatgctcgtgtggctctaggattcacacctgtgtgggtgtgggtgtgtgcacgtgtgccattgtgtgtatatatgtgcagctatttctgtagattctattgaattatttttcagttaattttttccctggaaacaactaacctgattgggagaccatccagtgaatttttcatttaagatataccttttaatagtcctttaatttgatttgactcttttatccttttactttcccttgatatgatatctgttacgttccatgtttatgttttcttaaatccagcaatgcagttatgatactaatatgtcaaattctcatgccatttaaatcatttctatcattcctggttctatttttattgactgattattttcctggttatggttcacactaaatgcttttttatgtgtagtaaagttataaatttaggactcacactgtggatattgcatagctcagcaacttaactttgttgttcacctgtaaagagtgttgagttttcttctagaaggcagttaattgactaggacaccattttaatgcttggagatttgcttttcagctttgctaggttttttctggagctgcctttattctaggaatatacaaagtctactcataaagtctgacttttctgaggtctctactgaatgcccaagattttcaatgaggtctcttctctctagctggtcaaaactccaatattccagagcactatgtgagctctgtcacctttattaagctcactgttcccttgtagttgttgttcctcaatatatggtgtttttttgccatattttcttgtggaaaatcttctatgcaagtgctgctttatgtttagactaacacttgaggagacttctatgcctggagctcctatcctccacaagtccattcttactcttagcatggctagaaaatcctaactacctgagtaatcccaaagtccaatcactctcctctgttcagcaacatggctacagtcagcttgggctccatctccttgctcttcagtgcaggaagggtctccttgaagaaagccaaggcattgatgggttgatctcattttctccctcttgcaatactcttggtcctctagcatctgttgttcaacatgtggaaaccgttttgccgtgtctttggtagtcacttatggccgaaagactggccatagaatggccagatcatggcttctgtccatctacccgccccttttacttttcagcatcgcccctttgctgactctcatctgctttcctgcctttgttcttctcctctgggcagaccgtatctcttcagaccactggtgctcaggaccaagtgtgtttgtacccattgaaaaagaagtagatagaaaaagatttgcctctccatagatgtgcaagtatcaattccctgtgacccaagatgcaaaaggccaacacaacattcacttcagggactagagcttagaatgatagaattccaaggtgaaaaggttgtattaaccctcagccgatgttgtagaaggatactctaactctttggtcatttgtcatcccggctgttttattaataagatcttctcaactccatatatccttctgcttccataaaactaggaggaaggagagccagcttaaaaaatgtcttctcagccaggcacggtggctcacgcctgtaatcccagcactttgggaggctgaggcaggcggatcacgaggtcaggagaccaagaccatcctggctagaacagtgaaaccctgtctctactaaaaatacaaaaaattagccgggtgtggtggtgggtgcctgtagtcccagctgctagagaggctgaagcaggagaatggtgtgaacccgggaggcggagcttgcagtgagccgagatcatgccactgcactccagcctgggcaacaaagcaagactctgtctcaaaaaaacaaagtcttctctaagaacttttgctcacaggaaatgttcctctgcatctgagccaagttgagtcctgagcagtcaccttgaagcatgactcttctaacagaaacttccattggcccttccttcgcttatggtaaagaacaaagacgtacgcatttgggtagttttctggggtccgactatgctggtgtggtgtcatagatgaccaagcttggcaagttcttcctgtgacagtggtggagtatgtgcctcggtaactctgtccataatggtagtagcagtcctgtaccccgggggtttcctcagtcagtgctgaaattaaaacagaagacatcaagcttattatttcctagaacagaaaaatacaggaagccatttatgacataaaccaaaaaagagtcactgagatttacaaccattctctattctttattaataggcaaatggacatgagaaaacacacaaacaaacacgaaagtaagagatgcctaccattctagaactgtagtaagttcttagaaatatttcatgtaaaacttagtggaaaagaaatatcagattgcttctcatcggaaactccactaacatggaagctcatttctaggaatctctacagagtgttcatgacgacatggaacagcatagaagaaagggtgatgcatttggcaaagctgaaaagcaagtctccaagcattaaaatggttttttggggaggaggcaaggacatataaaaaccttgcatgtgtccctagatgattgctcaaaaaagaaagcattaaactcctggtgatggggcagacaacagtcctgcagctaaaactgtaggcaacaacacttcacttctcagggatgagtggaggccaaaagcttatcacctacaataagatagggaatcctctcgtgcccagcataatgcattgcaataaagcaaaagtctactactctttttctccagaccccccgcaggtacaagttccatcagaaagaggcaaaagcacacgaaaaaatcactcccttcaaagctaagaactgcacaacctgcctcggactgaaaaagacctgagagatagagcttcgggagctcatgtactactccacagacccagggagatatggaattaatgcaacccagttaggtttctcaaggataacaggatctagagccacatttctcggaatctgcaatgctgaagattgcactgaatgctgtctacttgaagaaatccctggaaaagtttactggcttggaaagacacacacatctgacagcatattacaataagaattttgtctaggacaatgagatagccccttttacaatgaggggagtggtgaagtcgagcacccagaatggtttccgcccatcctaaagacacagctcgcacaggttgcaccaaaaatcacacctctggctcccccagagagtgcgctaaggcttcctcccacatggcagacccagaaccaacacacgagaaccagtgtagcactgaagggttgtgcgtcagtgggggtatccatggcttttcatcccagcatccaagcaggtaaatgtctggcacaacttcttaccttgttcaaaaaaagcctctaggcttggagccagaataacattcggagggacgaaggcagtccattctgcatctgagcatcgtgtcaggttgcagtactcccacctgacactgggatctgttgtataacaccaaggggctgccacaggatctggatttcggcagtagttcttgatcaagccactggaaattccaaaagaatacacatcacaaaaaatgggtacatatgcaggaacactgtatattttgctacaacaaggtcattactggtgcctttgaaatattcccaaaagagataccatacaattgccacaatgacaaatggctctcaatctctaatcctctctgcacatttctcatacttaatatattatcactttttttaaagaaaaaaaatctaatgcagcacacacttcctagaaacactgagattatacatacatgtggccaaaaagggatcagaatatcctccttctgccttctgcccaatccatctctctggaataactggtatggattttgacgtgtgtattgtggaattggttatgcacatacaaaagtatctctatctgtctagctctccgtatctctctgtgtaggacttcatatagtaatgtgcgagttggaactaacacatagttctccagagaaaaaaatggcatccagcatgatatccttcccaggccagcagtctcattcaatgtactcaaaatgtagccaaaaggctctatgttcagcatgtaaaaccattgcacaaaaagtattcctgtctgtcgataccgtatcaggtgggtcaagtgggtttctttctgcaagacttctcaaagctgccctggaaacctagctttcaggcaggatgcagtatctctaggatgggttcctggtcaggacttcctctcctgctctcagtccatcctctgctggccacagcaattccgggactgagggaatgggggatgagttgaaagaacagtggcactcatggcataaagggagacagctgggcagactatgaggtctgaagaggtcgggcagctatggaggacctcaggctggggaaatctcagagcattcactcctccttatgcctcctaagaacattgctccaacctctcagaatcctcccattcgtgacctgtggctgcctgggaaaacgggaaatgtattatgggccatggggatccaacactgtctctctagagactctacacatgtgacctagtctcaagcccagaccctccattccaggaagctggttcaatgagcaactggatgtgctcagagcttgagtacttgaaagacttctttttcttccttggcttccctcttttggatacatggaaaattcttattatataatatccctcagaattcaaaattttatgattgctttaggatttacaatatccctttggacccacaaattcaacctttcattaatattacataccatcgtggataaggtaagaaacttacaatggtacacttccaattattccccacatgatttagtctatatgttcaaatttttacctctacatatgctaaagttaaatatattgctatcattttgcttcaagtagtcaactctcatttaaaaagatatagaaatttgatcaagaaaatattttgcatttacatctacatttgccatttgctgggttcttcattacgtgggctgcagaaagttctcctcttgaactattcttcttctagctaattttctttgggcaacatctcttgttacacaagcctgctgattccaaattattagtttttggtttatttatttggggcagtgcacaatatgcatttatccaacatggatgatcttcaaggcattttattgctggatgtagcattctcatttgatctcttttttttctagtttatcattttaatgatatcccctgttaactgggttccagtgtttctgatgagaatgcattagcaatttgtatcactgttcttctagcaagacacagctctttttcctccagtttctcatgagatgtttcttgttattatatctttgccttctgactgttgaacggtgatgtacaaaagtgaatcatacagtttttttttttttttttttggaaattccctgtctgattcattcagcttcttgaatctgtggtttttaatattcttcttatttgaaaagtttttagctatccttgcttccagtatttgttcctgtagcaatctctccttcctctccttctgtgacttcctacccacatgcaggaaatctttttatattttcccgcctgtctgtgaggatcagtggatttcattttttagtatttgtggaggtgtgtgtgtgtgtgtgtgtgtgtgtgcgtgcatgtttctaagcctgtgcatgtgtgagtatgtgtgtatatgtgtgtgtcatttgtgtatgtgtagctggttctgtaggtggtataaaattgtttttcagttagtttttacttctgaaacatctcactccattgggaatacatccagtaattttttcatttaagacataccttcttatactagttctttaatttaatttggctcttctatactgttactgtctcttgatatggtatctgcttcattccgtattcatgttttcttaaaacctaaaactcagttgacatattgatatgtcaaattttttgccattctaatcatttctgtcatttctaggtctatttgtattgactgatttttcacctggtcatggttcatactaaaagcttctctatgtgtagtcaagttttaaatttagaactcacactgtgaacaccacatagctgagccacttgactttgttgtttacctctaaagagggttttcctctcccaggcagttaattgacttggaaatgattttaatgcttggagacttgcttttcagttttgccagggtttgtctagagctgcctttttttctagaaatttactaattctactcctaaagtatgacttttctggagtctctactgtattcccaagaggttcagtgaggtctctcctccagctggtcagaactccagtatcccagaatgctatgagggctctgtcctctttattgagctcactgttcaatcgcagttgctattcctcaggatatattcttttctctactttcttgtggaacctttttctgggcacatgcaacgtcatgtttagccaaagattcgaggagactactatgcgtgcccctggagctcctttcatccacaaatccattctcattctcagcaggcctataaaatcctagctaccacagtagtcccaaattccaatctctctcctgcattcaggaagatggctacagtccatctgggctccatcaccttgctcttcagtgcaagaagggcctccaggaagaaagccaaggtatctatggagttgatctcattgttccccctgtcactattcttttggtccactactgtctgttgtccaacatgtagaaaccatttttccatgtctttggtgtcacttatggcctaaagcctggccatgggctggtcagacctgggcttctgtccatctatccacccttttactttacaggatctctctctttgctgactctcatctgccttcctgccatttttattctctaacaaccagtatcccttcagaccactggtggtcagaaccgactgtgtttctacatattggaatagacgtagatatagaaagagatagatttgcctctccatagatatacatatatactttccttgtaagccaaaacagaaaaccccaacagaaccttcacttcaggaattggagtttagtttaatagaattccaaggagaaaaggctgcattgaaccttagtgggtgttgtggaagggtactctaagagtttcatcatttgtcatcttgacttgtttcttaatgtgatatccttgcctccagatacctttctgctccattaaactaggaggaaggagagccagattaacatttgtcttctcttagactctttgctcaaagacaatgttcctgagacattttgctatgcactgttcatctgagacaacttgagtcctgaacactcagcttgaagcatgactctactaacagaaatttccactgacccttccttcacttatggtaaagaaaatagacatacgcatttgggtagtatgctggggtccgactatgcgagtgtggtgtcatagatgaccaagcttggcaggttcttcctgtgacagtaatgaagtatgtgccttgataactctgtccatttccgtggtagcactcctgcaccccaggcctttgctcagttggtgctgaaatgaaaagaaaagaaatcaaactgagtgtttccaagaagagacaaacatgtgaagccacttatggcacaaaccagaaaaaagtctctgagaattatgacctcaggagaatatgacaagtaacattcttgtttctttatttgtaggcagatggacttgagaaaagcaacaaccaaccaacaaacaaaaacaccaaagaaacaaattcctaacactttagaactgtagtaagttcttagaaatatttcacataaaagcttagaaaaaaaggacaaatgagagggcttctcaatggaaactgtgctcacgtgcaagcacatttatgggaatttctactgaatgttcatgaggactatggggcagcaaacagcaaagcacgatgcatttgggggtacaggccatacatggtgattgggtgttaggggcagagaaacggacagacatgaaaacaatgaacgtttcataacaaaaggcaaggtcttcagcttctgggccatgggagagacaacagtccttcgtctaggactgcagacaaagacacttcagttatcagggatgggtggaggcgaacagcttactcccctgcaggagagatgaaatcctctcatgacccacatcctgagttgcaataatacagaagtctccgactctttctatccagaccgctcacaggtacaactgccaccagaacacggggcagtcactcacttaaaaacctagggctgcagagcccacctatgactgaggaagtcctgaaacatagatcattgggagttcatgtactgctccatagaaccagggtgatttggaattaatgcaaccctgttagccctgtttctcaagggtgacaggctccagagccacatttctctgaatctgcaatgctgaagattgcactgaatgctggctaattgaagaagtcccaggaaaagcttactggcttggaaagagtcacacatctgacagcatgttacaataaaaattttggctaagacactgagatagcccatttttcaacgaggtgagttgtgaagtcgatcaccctggagggtttgtgccaattctaaagacacagcccacccaacgttgtaccagaaatcaatccgctggctcccccagagagtgcacggaggcttcctcctacatgacagaactcagtcaacactcgagcatccgtttaccattggaggctgctgcatcagtgggaatttccatggcttttcatcccagcatcgaaacgtgtaggtttctggccacaggctccttaccttgttcagaaggagcctctaggcttggaatcggggtaatagttggaggcgcgacggcagtcccttctgcgtctgagcattgtgtcaggttgcagtactcccacctgacactgggatccctcgtataacaataaggggctgccacaggatctggattcctgcagtagttcatgatcaagccactggaaattccaaaacgatacacgtcacaagaggtgggacaatatgcaggggcaccccacaccctctcctttgtgctgcaacaaggtcattaccagtgcctttctaatattcccataaaagtaccatatgattgccacaagcacaaatggctctcaatcactaatcctgtctgcacatttctcatacttaaaagattattattataaaaaaaaatctaaagtagcaaacgcttcttagaaacactgagataatacatacacgtgggcaaaaaacgatcagagtattctccttctgccttctgcccaatccatctctctggaataactggtatggattttgatgtgtgtattgtggaatcgtttattcacatacaaaagtatctgtatttatctagttctccgtatctctctcggtaggacttcatattctaatgtgcaagttgcaactaacaggtagttcttcagaaaaaacatgggatccaggaggataacctttccaggtcaaccttcactctctatgtactcaaaacctcgcgaaaaggctctacttttcccatggaaaagcactgtgcaaattgtattactttctgtcattcccatatcatgtgggtcaaataggtttgtttctgcaagacttctcaaagctgccctggaaaacttgctcccaggcagaatgcagcatctctagaatgggttcctgggcaggaccttctctcctgctctcagtctaccctctgctggccgcagctactctgcactgagggaaagggggatgagttgaaagaacagtgggacccatggcataaaggaagatggcagggtagactaagagatctgaagaggtcggacagctacggaggaacactgcattagggggcaaagcaggtaggagtttgggctgcggggatcttgaagcatttgctcttccttatgcctcccaagaacgttgctccaacctctctctatcctcacattcatgacctgtggctgcctgagaaaatgggaaatgtattacgggccatggggatgaaacactgtctctctagagactctatacatgtggcctagtgtcaatcccagaccctccattccaggaagctggttcaatgagctacaggatgtactaagagcccaaactcgtgacaaatttctttcttccttggcttctctcttttgaatacatggaatattcttattatacaatatacctcagagttcaaaactttgtgattgctctaggatttgcaatatctccttgaacccacacagtaacattttattaatattacataccattgtgcatgaggtaagaaacttacaatggtacacttctaattattccctacatgatttacgctacttgttcaaattcttacctctacatatgctaaaattaaatatattgctatcattttgtttccagtagtcaacgctcatttaaaaatatatagaaatttggtcaagaaaatattttgcatttacatctacatttgccaattgctgggttcttcattacatgggctgcagaaagttcccttcttgtactattcttcttctacctaattcctttgggtcacctctcttgttacatcagcctgctgattccaaattcttacagtttccggtttctttgtttggggcagtgcacaacatacatttatgcagcatggatgatcttcaaggcattttattgctggatttagcattcttggttgatctcttcttgttcctgtttaccacattaataacattcccggtatctggcttccagtgtttttgacgagaatgcattagcaatttgtatcactgttcttctagcaagaaacagcttgtttttccccagtttctcataagaagtttcttgttattatatctttgtcttcttaccgtgaaaatgtgaagtacaaaagtgcatcataccagattttttctttttttcgaaacgcctatttgatgcattgaatttcgtgtttttgcgattttgttaatattcttgatcaatgaaaagttttcggccatccttgattccggtatttgtttctgtttccaatctcccgttctcttttctgtgacttgcttcccatatgcaggaaatcttttcctattttgcaacatgtctgtgaggttcggttggttttctatttcactatttcttgagggttgtgtgtgtgtgtgtgtgtgtgtgaacttgtgagtttttgcgtgggtgtgtatgggtgtgttgtatgtgtatatatgtgtgtagttggttctgtagaattgatttttggttagtttcctattcagaaatgtctaaattgatcaggcagccatccagtaattttttcttttaagacatagctttttacactaagtctttaatttgatttggctagtcaatactgttactttcttttgatattttatctgttttattacatattcatctttttttaaatatttgaaatagttatcttagtcatatgtcaaattttcatgcaattcttctattcttcttatacctaattctttcgggtcacctctgttgctacataagcctgctgattccaaagtcttacactttccagtttctttgttttgggcagtgcacaatatgcatttatccaacatggatgatcttcaaggcattttattgctggattcagcattctcggttgatctcttcttgttcctcattatcattttaataatattccctggtatctggcttccagtgtttctgaggtgaacgcattagcaatttgtatcactgtactctaggaagacacagctcttttttctccagtttctcgtgagatgtttcttcttcttatatccttgccttgttacctttgaactgtgatgtagagaagtgcatcatgtagttttttttctcgaaatttcctatttgatccctttagtttcatgaatctgtgatttttctaacgttcttcataattgaaaagttatcagccatccgtgattccggtatttgtatctactccaaactcccttgctctttactgtgacttgcttcccacatgcaggaaatcttcttatattttcctgcatgtctctgagggtcggttaattttatatttccctatttctttagggatgtgcatgtgtgtgtgtgtttgtgtgtgtgttagaacttgtgagtttttgcatgtgtgtgtgtatgggtgtgttttgaatgtgtgtgtgtgtggctcattctgtaggttctgcagaattgtttttggttaattttttcttctgaaacatctaaatttttcaggcggacatacagtaatttcttcatttaagacatactttttgtataatagttctttaatttgatttggctattctatactattaatttgtcttgatatgatacctgctttgttgcactttttttaaatatctgaaatcagttatcatactgatatgtcaaattttcatgcaattctaattatcgatgtcatttctgagcctgtttgtattgcctgatttattttctggtcatggatcacacgaaattcttttctacacgtagtcaaatttttaatttaggactcactctggggataccgcatagctgaggcaattgactttgttgtttacttctgaagagagttgagatttcctctcacaggcacttcattgattggaaacccatttgatgcttggacacttgcttttcagctgtgcaaggggttgtctgcagctgcctttattctagtaatatactaattgtactttgaaattatggctgttctggggtctccactgaattggcaatgtgttccgtgagcactctctcatctagctggtaagaactccaataacacagagtgctatgtgatctctatcttcttaattgagcttgctgttctcttgtagttgctgtttctcagtaaatgttctttgccacactttctgtagaaccattttctgtgcacatgcagtgtcatgtgaggccaactactggaggagacttctatgcgtatttgtagagctcctttcctccacaaaccagttcttatttgtagcggacctagaaaataccagagtcatcccaaactccaatccctctcctctgctcagctagatggctacaggctgcttgagctccatctccttgctattcagtgcaggaagggtatccaggaagaaagccaaggcatctatggagttgagctcatcattggccctctctcaattctctaggtcctctaccatctgttgtcccacatgtagaaaccatttttccatgtctttggttgttgattatggccaaatgattggccatggggtggtcagaccagggcttctatccatctacccatcccttttacttttcagcatccctctctgtgctgactctcatctgccttccttccttggatcttctcttgctgggaacctctatcctttcaggccactggtacttaggaccaagagattttctccctattggaatacaggtagaaatagaaacagatcaattcacctgtccataagtaagcacataaactttcctcatgagcccagacagaaaaggcaaacacaatcttcccttcaggaattggaagtcagaataacggaattccaactggaaagtcttcattgacgcttagtgggtgttgggcaagggtaatctaagtgtttggtggttcgtcattctgactttcttcataaggtgatctcctcgcctcctcatttcccttctgctccacaaaactaggaggaaggtgaggcagcttaacatttctcttctctcagacccttagctccaaggaaatcatcctgagacattttgctacaccatctgaatctgacacaagttgagttcggagaactcagcttgaagcatgtctcttgtcacagaaacttcagttggccctttattctcttatggtaaagaacaaagacatacgcatttgggtagtattctggggtccgactatgcgagtgtggtgtcatagatgaccaagcttggcaggttcttccagtgacagtggtggagtatgtgcctcgataactctgtccattaccgtggtagcactcctgcaccccaggcctctgctcagtcggtgctgaaatgaaaacacaagaaataaactgagtatctctgagaataacgaaatatgtgaagccatttatgacacaaccagaaaggagtctatgagaattatgaacgttatctttcccttacctgtaggcagatggatgggagaaaaccaaccaaaaaacatacagcaaacctacagattcctaccaatctagaactgtagtaagttctaggaaatatttcacctgaaatccttagaaaaacagaacagaacagactccttctcactgcaaagtgcgctcacgaagtagcacctttctatgaaactctactgaatgttcatacaaagggcactgcatttggcaatgcaggatgcaggtggtaattggctgtcgagggcagaggaggggaaagacatggaaattttgcatgtttccctagatcgttgatcatgaaagccaaggcctctggcttccaggccatggggcagaaaacgatcctatatatctgactgaaggcaaagacactttgcttctcaaggatgtgtgcacgccaaaaccttcttcccttggaggagggagggaatcttctcatgccctgcatcctgaattgcagtaaaggagaagtctactaacctttctctctagacccctcacaggtacaagtgccatcagaaagaggtttaagaacactgagaaatcactcccttcaaagcctaggactgaagagccttagagcattgggagctcatatactgctccatagacccaggaccatatggaattaatgcagccctgttaggtttctcgaggatgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcgtctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacgcacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgaccttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattacatctttgccttgttaccttcgaactgtgatgtacaaaagtacatcatacaggttgggttttttttccgaaattccctatatgatcccttgagtttcacgattctgtgattttttttaatgttcttcgtaattgaaaagttatcagccatccttgattctggtatttgtttctattataaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtgtgtgtagctcattctgtaggttctctaaaattgtgtgttgggtaatgttttcctctgaaacgtctaatttgatcagccggccatacagtaatttttttcaattaagacatactttttttatactagctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatattctaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggcagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacgcacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgaccttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattatatctttgccttgttaccttcgaactgtgatgtacaaaagtacatcatacaggttgggttttttttccgaaattccctatgtgatcccttgagtttcacgattctgtgattttttttaatgttcttcgtaattgaaaagttatcagccatccttgattccggtatttgtttctattccaaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtagctcattctgtaggttctctagaattgtgtgttgggtaatgttttcctctgaaacgtctaaattgatcagccggccatacagtaatttttttcaattaagacatactttttttatactacctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatcttctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggaagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacacacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgatcttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattatatctttgccttgttaccttcgaactgtgatgtacaaaagtacatcatacaggttgggttttttttccgaaattccctatgtgatcccttgagtttcacgattctgtgattttttttaatgttcttcgtaattgaaaagttatcagccatccttgattctggtatttgtttctattccaaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtagctcattctgtaggttctctagaattgtgtgttgggtaatgttttcctctgaaacgtctaaattgatcagccggccatacagtaatttttttcaattaagacatactttttttatactagctctttaatttaatttggctattctgtactgttaatttctcttgatatgatatctgctttcttgcatgttgtttttttaaatatttgaaatcagttatcatactgatatttcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggcagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacgcacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacaatgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattctgacagtttccggtttctttctttggggcagtgcacaatatgcatttatccgacatggatgatcttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattatatctttgccttgttaccttcgaactgtgatgtacaaaagtacatcatacaggttgggttttttttccgaaattccctatatgatcccttgagtttcacgattctgtgattttttttaatgttcttcgtaattgaaaagttatcagccatccttgattccggtatttgtttctattccaaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtgtgtgtgtgtgtgtgtgtgtgtgtgtgtgtagctcattctgtaggttctctagaattgtgtgttgggtaatgttttcctctgaaacgtctaatttgatcagccggccatacagtaatttttttcaattaagacatactttttttatactagctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctcccacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctggctctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttccagtgacagtggtggagtatgtgcctcgataactctgtccattaccgtggtagcactcctgcaccccaggcctctgctcagtcggtgctgaaatgaaaacacaagaaataaactgagtatctctgagaataacgaaatatgtgaagccatttatgacacaaccagaaaggagtctatgagaattacgaacgttatctttcccttacctgtaggcagatggatgggagaaaaccaaccaaaaaacatacagcaaacctacagattcctaccaatctagaactgtagtaagttctaggaaatatttcacctgaaatccttagaaaaacagaacagaacagactccttctcactgcaaagtgcgctcacgaagtagcacctttctatgaaactctactgaatgttcatacaaagggcactgcatttggcaatgcaggatgcaggtggtaattggctgtcgagggcagaggaggggaaagacatggaaattttgcatgtttccctagatcgttgatcatgaaagccaaggcctctggcttccaggccatggggcagaaaacgatcctatatatctgactgaaggcaaagacactttgcttctcaaggatgtgtgcacgccaaaaccttcttcccttggaggagggagggaatcttctcatgccctgcatcctgaattgcagtaaaggagaagtctactaacctttctctctagacccctcacaggtacaagtgccatcagaaagaggtttaagaacactgagaaatcactcccttcaaagcctaggactgaagagccttagagcattgggagctcatatactgctccatagacccaggaccatatggaattaatgcagccctgttaggtttctcgaggatgacaggctccagagccacattttttgaaatctgcaatgctgaagattgcactgactgctggctacttgaagaaatccccagaaaagcttactgcgacagaaagaatcacacacctgacagcacgttacaataaaaattttggctaagacactgagatagcccattttagaaggaggtgagttgtgaagcccatcaccctggaaggtttgtgcccattctaaagacaaagcccacccaagttgcaccagaaatcactccgctggctcccccagagagtacacggaggcttcccccaacatggcagaactccggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgcctcctacccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacacacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgatcttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattatatctttgccttgttaccttcgaactgtgatgtacaaaagtacatcatacaggttgggttttttttccgaaattccctatgtgatcccttgagtttcacgattctgtgattttttttaatgttcttcgtaattgaaaagttatcagccatccttgattccggtatttgtttctattccaaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtttgtgtgtgtgtgtgtgtgtgtgtgtgtagctcattctgtaggttctctagaattgtgtgttgggtaatgttttcctctgaaacgtctaaattgatcagccggccatacagtaatttttttcaattaagacatactttttttatactagctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggcagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactatttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagaaaacacacgtcatccaggaggatagccgttccaggtcaaccctcacactctatgtactcaatacgtagtgaaaaggctctacctttcccacagaaaagcattgtgcaaatagtattactgtctgtcaggtttagtaggtttgtttctccaagacttctcaaagctgccctggaaaacttgctcccaggcaggatgcagtatctctagaaggggttcctaggcaggtccttctctcctgctctcagtctaccctctgctggccgcagctactccgggactgagggaaagggggatgagttgaaagaacagtgggacccatggcataaaggaagacggcagggtggactaagagatctgaagaggtcggacagctacggagcagcagagaaaaatgcattagggggcaaagcaggcgagtagtttgggctgcggggatcttgaagcattcgctcttccttatgcctcccaagaacgttgctccaacctcccagtatcctcacattcatgacctctggctgcctgagaaaatgggaaatgtattatgggccatggggttccaacactgtctctctagagactctagacttgtggcctagtctcaaccccagaccctccattccaggaagctggttcaatgagcaactggatgtataagagcctgagctcttgaaagacttctagttcttccttggcttccctcttttgaatgcatggactattcttattataccaaaaacctcagagttcaaacctttgtgattgctctaggatttgcaatatcccttcgaacccgcacagtacccttttattaatatgacacaccatcgtgcatgaggtaaagaaacttacaacggtacacttcgaattaatcccttcgtgatttatgctaccatttcaaattcttacctctacatatgctgaagttaaatatcttgctatcattttgtttcaagtagtcaactctcatttacaaagatatagaaatttgatcaagaaaatattttgcatttacatctatctacatttgccaattgctggattcttcattacgtgggctgcagaaagttcctttcttgttcaattcttcttctacctaattccttcgggtcacctctcttgttacataagcctgctgatttccaattcttacagtttccggtttctttctttggggcagtgcacaatatgcatttatccgacatggatgaccttcaaggcattttattgctggattcagcattcccggttgatctctttttgttcctgattatcattttaacaatattccctggtatctggcttccagtgtttctgaggtgaacacattggcaatttgtatcagtgtacttgtaggaagacacagctctttttcctccagtttctcgtgacaggtttcttcttattacatctttgccttgttaccttcgaactgtgatgtacaaaagtacatcatacaggttgggttttttttccgaaattccctatatgatcccttgagtttcacgattctgtgattttttttaatgttcttcgtaattgaaaagttatcagccatccttgattctggtatttgtttctattataaactcccttgctctttactgtgacttgcttcccacatgcaggaaatcttttcatattttcctacatgtctgtgaggctcgcttaattttatatttcactgtttcttcaggggtgcgcgtgtctgtgtgtgttagaacttgtgagtttctgcgtgtgtgtgagtatgggtgtgttttcagtgtgtgtgtgtgtgtgtgtgtgtgtgtgtgtagctcattctgtaggttctctagaattgtgtgttgggtaatgttttcctctgaaacgtctaaattgatcagccggccatacagtaatttttttcaattaagacatactttttttatactacctctttaatttaatttggctattctgtactgttaatttctcttgatatgatatctgctttcttgcatgttgtttttttaaatatttgaaatcagttatcatactgatatgtcaaattttcacgcaattctaatcatttctctcattcctgagcctgtttgtattacccgatttatttcctggtcatgggtcacacgaaacgcttttctacatgtagtcagattttaaatttaggactcactctgcggataccgcatagctgaggcaatcgactttgttgtttacttctaaagagagttgagatttcctctcacaggcacttcattgattggaaaccgatttgatgcttggacacttgctttccagctgtgcaaggggttgtctgcagctgactttattctagtaatatactaagtgtacctttaaattacggctgttctggggtctccactgaattggcaatgtgctccgtgaggactctctggtctagctgggaagaactccagtatcccagagtgctatgtgatctctctcttctttattgagcttcctgtgctcttgtacttgctgtttctcagtaaatgttctttgccacactttctcgtggaaccatttcctgtgcacaggcagcgtcatgtcaggccaacgactggaggagacttctatgcgtatttgtagagctcttttcctccacacaaaccagttcttatttctagcagacctagaaaaatttcagctaccacagtcatcccaaactccaatccctctcctccattcagcaagatggctacagtctgcttgggctccatctccttgctattcagtgcaggaagggtatccaggaagaaagccaaggcatctgcggagtggagcccatcattgcccctctctcaattctctaggtcctctaccatctgttgtcccacatgtagaaaccatttttccatgtctctggtagtcgcttgtggccaaaatattggccattgggtggtcagacccgggcttctctccatccacccatcccttttacttttcagcatccctctctgtgctgactctcatctgccttccttccttggatcttctcttgctgggaacctgtatcccttcaggccactggtacttaggaacgagtgtttttctgacaatcggaatatacgtagatatagaaacagatcaattcacctgtccataaataagcacctattctttcctcttgaacccagagagaaaaggcaaacgcaaccttcccttcaggaagtggaagccagaataacggaattccaactggaaagtctccattgacgtttagttggtgttgtggaagggtaatctaagtgtctggtcctttgtcattctgactttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgactatgcgagtgtggtgtcatagatgaccaagcttggcaggttcttcctgtgacagtggtggagtatgtgcctcgataactctgtccattaccatggtagcactcctgcaccccaggcctttgctcagtcggtgctgaaatgaaaacacgggaaatcaagctgagtatctctgagcatagagaaacatgtgaagccatttgtgacacaaccagaaaggagtctatgagaattacgaccgttctcttttccttatccataggcagatggatgtgagaaaaccgaccaacaaacaaacaccaaagcaacagattcctcccattctagaactgtagtaagttcttggaaatatttcacctgacaccttagagaaacacaacagatcagattcctcattggaaagtgagctcacgaggtagcacctttctaggaaactctactgaatcttcatgcaaacggcaccgcatttggcaatgcgggctgcaggtggtaattggctgtcgggggcagagtttgggacagacatggaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagacccctcacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttctcgagggtgacaggctccagagccacatttctcagaatctgcaatgctgaagattgctctgaatgctggctacttgaagaaatccccggaaaagcttactggcttggaaagagtgacacacctgacagcatgttacaataaaaattttggctgggacactgaggtagcccgttttacaacaaggtgaattttgaagtcgatccccctggagggtttgtgcccatcctaaagacaaagcccaaccacgttgcaccagaaatcactccgctggctcccccagagagtgcacggaggcttcctcctacatggtagaactcaggcaacactcgagcatccgtttaccattgaaggcggctgcatcagtgggaatttccatggcttttcatcccagcatcgaagcgtgtagatgtctggccacagactccttaccttgttcggaaggagcctctaggcttggaaccggggtaacagtcggaggcgcgacggcagtcccttctgcgtctgagcattgcgtcaggttgcagtactcccacctgacaccgggatccctcgtataacaataaggagctgccacagcatctggattcctgcagtagttcatgatcaagccactggaaattccaaaacgatacacgtcacaagaggtgggacaacatgcaggggcaccccacactctctcctttgtgctgcaacaaggtcattaccggtgcctttctaatattcccattaaaagtaccatatgattgccaccagcaaaaatggctctcgatcactaatcctctctgcacatctctcatacttaatagattattactattttttttaaataaaaaatctaaagtagcaaacgcttcttagaaacactgagataacacacacacgtggccgaaaaacgatcagagtattctccttctgccttctgcccaatccatctctctggaataactggtatgggttttgacgtctgtattgtgggattgtgtattcacatgcaaatgcatctgtatctgtctagtctccgtatctctctcggtaggacttcatattctaatgtgggagttgcaacgaacatgtagttcttcagagaaaacatggcatcaaggaggataacctttccaggtcaactctcacactccatgtactcaaaacctagtgaaaaggctctacctttcccatggaaaagcattgtgcaaatagtattactgtctgtcattcccatatcatgtcggtcaagtaggtttgtttctgcaagacttctcaaagctgccctggaaaacttgctcccaggcagaatgcagtatctctagaatgggttcctgggcaggaccttctctcctgctctcagtctatcctctgctgtccacagccactccagaactgggggatgagttgaaagaacagtgggtcccatggcataaaggaagatggcaggaagactaagagatctgaagaggtcggacagctatggaggagcaaaaaacaatgaattaggaggcaaagcagctgaggagtttgggctgcggggatcttgaagcattcgctcttccttatgcctcccaagaacgttgctccaacctctcagtatcctcacattcatgacctgtggctgcctgagaaaatgggaaatgtattatgggccatggggatccaacattgtgtctctagtggctctacacatgtggcctagtctcagtcccagaccctccattccaggaagctcattcaatgagcaactggatgtactaagagccagagctctttaaagacttttttttcttccttggcttccctcttttgaatacataaaatattgttattatacaacaaacctcagagttaaaaactttgtgattgctctaggatttgcaatatccctttgaacccacacattaaccttttattagtattacatactatcgtgcatgaggtaagaaacttacagtggtacacttccaattaatccctacatgatttatgctacatgttcaaatttttacttctacatatggtaaagttaaatatattggtatcattttgcttcaactcgtcaactctcatttaaaaagatataaacgtttgatcaagaaaacatgtagcattttcatctacatttgccaattgctaggttcttcattatataggctgcagaaagttcccttcttgttctattcttcttctccttaattccttagggtcacctcttttgttacataagcctgctgattccaaagtcttacagtttccggtttctttgtttaggggagtgcacaatgtgcattcctccaacatggatgaacttcaaggcattttattgctggatgtagccttctcagttgagctcttctttcttacgtttattactttaatgttattcttttgtgtccaggttgcagtgtttctgatgggaacacattagtcacttgtatcactgttcctctagcaagacacagctttttgtttttcccgttccttacgagatttttctgtgtattatgtctttgccctctgacagttgaactgctatgtacccagtggcatcctataattgtcattttagaaattatttttctgatccattgagcttcttgagtccgtgattttttaatcttctttatatttggaaaattttcagccatccttgctttcagtatatatttctgttccaatctccttccccctttctgtgacttgcttcccacatgtaggaaatctttttatgttttcctttatgtctgtgtggctcggttgatttcatttttcagcatttgtggatgtgtgtgtgtgtttgtaagcttatacatgtttgagtgtgtgtgtatgcatgcgtgtgttttgtatgtgtgtatctggttctgtaggttctatgcaattatttttcatttggtattttcttctgaaatgtctaactagatggggaggccatctagtaattttttcatttaagacatatctcttagtagttcttcgatttggctctttatactcttactgtctctggataaggtgtctgttgcattctatattcatgttttcttaaatcctagaactcaattattatatagtgatatgtcaaatttttatgccattctaatcatttctgtctcttctgggtctgtttgtattggctgattttcctcctgcttgtgggtcacactaaaaggtttctatgtgtagtcaagttttatatttaggcctcacactgtggatactgcatagctgagccacttgactttgatgtttacctctaaagatggttgagttttcctctcagaggcagttcattgacttggacatcattctgatgcttggagacttccttttcagttttgctattgtttgtgtggagctgcctttattctaagaatatactaattctactcctaaagtatggcttttcctgggtctctactgaatgcccaagatgttcagtgaagtctctctcctctgtgtggtccaaactccaatatcccttagtgctatttgagctctgtcatgtttattgagctcactgttccattgtagttgctgctcttccgtagatgttctttgccctactttcttgtggatctattttctgtgtacatgcagcttcatgtttagccaatgactcgaggagatttctatgcatatttctagaactcctttcctccacaaatctgttctcattgttagcaggcctagaaaatcctagccacctgaataatcccaaactccaatgtccctcctctgttcagcaagatggctacagttttttttgggctccatctcctgcccttcagtgcaggaagggtctccaggaagaaaaccagtgcatctgttgagttgatctcattgttctctctctcgcaattcccttggtcctctaccatctattgtccaacaagcggaaatcattttttcttgtctttggtagtcacttatgtgtgaaagactggccatggtgtggtcagaccccagcttctgtctatcttcccgcactttttattgtttagcatctgtctcatttcttactttcatctgccttcctgcctttgcttctctcttcctggcaacccgtattccttcagaccactggtgctcaggacccagggtgtttctacccgttggaatagacatagatatagaaaaagatagattcgcctttccatagatatgcacatatcatttacttgtgagccaagacagaaaaggccaacacaaccttcacttcaggaattggagattagaattatagaatttcaaggggtaaagatcacattgacctttagtgagtgttgttgaagctgactctgtctaaacattctgattttccattattgtggcctcaccaccgccagatattctcctgattttatcaaactctcaggaaagagagccagcttaacatttctcttctatcatactctttgctcaaagtaatgtttctcagacattttgccatgcattctatgtgtgagaaaaatttaatcataagaagttagcttgacgcacaccttttctaagacaaattttacttggaccttgttttgcttactgtaagattaatgacatacgcatttgggtagttttctgtggtcctattatgttgatgtggtgtcatagatgaccaagcttggcaggtccttcctgtgacagtggtggagtacgtgcctcgataactctgtccatcaccatggtagcaatcctggaccacatggctttgctcaggtgctgctaaaattaaaacagaagaaatcaagctgaatagttcttagaacagaaaaaaatgtgaagtcatttatgacacaaacaggaaaaagtctctgagaattacgaccattctcttctcttgattagcaggcagacagacgtgcaaaaaaccaaaggaatagattcatatcattctagaactttatttaattcttagaaatattttatttaaaagtttagaggaagttaacatatcagaattcttctcaccagaaactatgctcatgtgcaagctcttttttagaaatctcttcttaatgttcatgaggaccacaggacaggagagatcagagggagatacatttggcactgcaagctgtaggtggtgatgggctgtcagggtcaaatatgaaaaccttgcacaattccctagaccactgctcagaaaagccaaagccttaagtttctgggcaatggggggagaaaaatggttttgcatctagcaccgcaggcaaagcccttcacttctcagggataggtagatgatcaaatcttatttccttggaggagagactggaaattttcttgtgcccagcatcctgcattgcaacatagcagacgtctgctactctttctctccaaacccaccacaggttcaagttccatccaaataaggcacaagaatactgagaatgcattcccttcaaagccctgcagaacctgactaagactgaagtggctccaggagatacagcatttgtttatttccaccaaagattgagcattcattaagaagaaacagcagtttcaatggggttagattatgtgtatgaagatatcccctctgtagtgcaggcatgcagtgactgctaaaatctaataatagataggaacactgagaaaattcttccacaccccaggccccactctaagcaaaagatagcagcaacccatcactggaggaatttaaacctgtggtgcatttaagataaaagcaacaagcacaaatgccaaattcagttcaaccagttactaggttgactcaattgaccacaaaacatattttcaacagaagatgggtgcccatttcaaagcataaataatatttactgcaatctctactgttcctccatttatgatacccagtgtttgattaaacaattacaagacacaccaaaagctgaagagggaagataagtcactgttaaataataaagcaatcaagacagacagactcagaaaagacaccatctggaaactatcagtttgggtttgtatgatacctatgttaatatgttaaagaatcttgtggtaaaggtggacaatatccatggatagggggagaatttcagcaaagagatggaaactatagaaaagagtaacatgaaaatgctaggaagagatttataatatcagagatgaagaattctctgaatgcactgaggagtcaattagacacaactaacaaaataatccataaacttgaacatagtctactagaacttatccaaaccaacacagatacaaaaaaagagttcctgacaaaaaaaaaaaagcagaagaagcatataaggtttatgaagcaatatgaatgatctaacatttgaatacttacagtccaaaaagaagaatacagagagagagaagtgaaaaaaaaaacaaaacagtagaatagataatggctatgaattttacaaaaacaataaaaatcaacaatctgcaaatccaaggagctcaggaaacctcaagcagaataaatacaaaaagttaataataaacaaattatagtcaaactgttgaaaaacaaagatgagaatatcttaaaggcagtcagagaaaaaggaactattgaatacaaagaaacaaagatcagatttctagtcagaaactattcaaaacggaatataatggaacatcattgttaaaatgatacaaggaatgaaactctcaacccagtatctatactcagcaaaatcacttttaaaaactgaaggcaaaataaagacttcttcagacaaagaaaagctgaaagacaacagcaacagcagtcccgtgctataagaaatgctaaaggttgtttttcacagaaagaatgtgactccagatggaaattgggatctactgtaaaagataaggagcaccagaaatggtaaaataaagaaattattcaaaatatttgtagtcataatcactttaaaaaacaactgattattcagggtaaaaatagtgtcaatgtattatgagagctataacataatagaagtaagcctctattacaaagagcaatagcacaacattttgagagggaggaaggagaagtgcaatgatgtaagatttctatatatccagtataattctgtcatttgaaggtggaatgtgaaaaaatcaaagtatatattataaacattgtggaaaatactaaaaccattaaaaattaatttaataagtaagtcgtggagataaactcaatataaatgaaggcagaaaaatatgaaaaaaggaacaaagtttaaatgggacaaagagaaataaccaacttaatggtagatttaaatttaatcctattaacaactactttaatgcaaatggtctgaacatctcaatttaaaagctgagaaaaagatatacaaatactagtgaaaatagagctgtgaaggctgtattcatatcagcacaaatagacttcagaacaacgaatacttccagagataagaagaaacattacataatgataaaggtcatcatcaagaagacctaacaatccaaatacacatgcctaacaacagagcttcaaaatatataaaacagagttacaatctaaaagagaaatagactaatctagagttaaagttggacacatcaccattaatcctcagtagtcaataaaaaaagagaaagacaagcagtaaggatacagaagaacaccagcaaccaccttcacctaaacgaccttgagagaacaccccgctcaacaacagaagaagacagtcttttgaagagtacatgaaagtgagttttagaactcaataatgagtaatgagttctgaagttgaatcagtaattaaaaacctacaccagaaaaacccctggaccagagagattcctagccaaagtataccagtcatataaagaagagctgatatcaagcctcctgaaacaattccaaaagataaaagaggacagactaactcattctatgaggtcgtcatcattctgatatggaacaacaaaaaaagaaaacttcaagccaatatccttgatgaacacagatgcaaaaattctcaataaaataccagcaattgaatccaagagtacatcaaaaagctaatccaccacaatcaagtaggttttattcctgggatataaggttggttcaatgtatacaaatcaataaatgagattaatgacataaattgtattagtcagggttctctagagggacagaactaataggatatatatatattttatatatattatatataatatatattatatataatatataatatataatatatattatatataatatatattatatataatatataatatatattatatataatatataatatattatatatattatatataatatatattatatatattatatataatataatatattatatgtatataaaggggatcttattaagtagtattaactcagcggatcacaaggttccacaacaggccctctgcaagctgaggagcaagaaagccagtccaactcccaacgctgaagaacttggagtccgatgttcaagagcaggaagcatttggcacaggagaaagatgtaggctgggaagctaattcagtctagtcttttcacatttttctccctgctttacaatctggccacactggaacttgattagatggtgtgtacccagattaagggtgggtctgccttcccagcccactgactcaaatgttaatctccttttgccacaccctcacagacataaccgagattaatactttgcatctttcaatccaatcaagttgacagtattaaccatcacaagtccaactccttgtcaacttgaacccatacacacatcctgaaatcatacataatcttcaaataaagacaataataaggtcataattatgcctaatataatacaactatcctcatacaaccagaaacgcaccaatccccaaaccaaaagttattacataaggttaacaatatttaaatgctgatatgaacaacacttaaatgcttaaatgctgatgtgaagtccataaatctaaggtcacatgataaaggaaaaataaaggaaataaaataaagatattttcttagcacaagtgtacacatgcatttagaaagtggatatagtgctgcagctgtccactttcgggtggtgcctgcatatcgtgcagaaccatctatgaaccagtccttagtcttcccttcctctgtcaactgatcatagggaactccccatgaggccattggtgcaggctgggggagggaaggcagggtggcatgagtggagaacatgggcatttgagccacttccttatgtaacttacttgtgccttcaggacctgctcaagcccgatcacatacacaccacttcaatttgatgatgaaatgccgctgtgctgacccacttcatggctagatgggtcagaaagcaaccagttcatgataggcaggttcaggtagcatggtgactttatgacccacagtcaaacgttcagttaccaccaaagcccaataacagaccaatagctgtctctcaaaaggagagtagttatctgcagaagtggcagggccttgctccaaaatcctagaggtctccactgtgattcacctatgggggcctgccaaaggctccaaacagcatccctatctgccactgacacctcaagcaccattggatctgcggggtcatgtggcccaaatggcagagcagctttcacagcagcctggacctgtttcagagccttcttttgttctagactgcacttaaatctggcagcctttcaggtcactcgataaatgggccagagtaacacacccaaacgaggaatgtgttgcctccaaaatccaaataggcccaccaggcattgtgcctctttcttggttgtaagaggggccaaacgcagcaagttatgcttcaccttagaaggaatatctccataggtctcatgccactggaaccctagaaattttaccgaggtagaaagtccctaaattttagctggatttatttcccatcctctggcatacaaatgtctcaccaataagttcagtgtgtttgctacttcttgctcactgtatccaatcatcataatgtcatgaatgtaatggaccagtgttatatctcgtggaagtgaaaagcgagcaaggtctctccaaataagattatgacacaaagctggagagttgatacacccctgaggtagggtggtaaaggtataatgctggccttgtcagctgaaggcaaattgcttctggtgggtcttatggacaggaatggagaaaaagccacttgccaagccaatggctgcataccaggcaccaggagatgtgttaatttgctcaagcaacaaaaccacaactggtagagcagctgcaattggagtcaccacttggttaagcttaaaataatccaccatcattttccaagatccatctgtcctctgcacaggtcaaatgggagagttgaacagggatgtggtgggaatcaccacccctgcgtctttcaagtccttgatggtgacactaatcacttcagtccctccagggatgggatattgtttttgatttttttatttttctaggtagagacagctctaatggcttctgtttggcctttcccaccataatagccctcatcctaccagtcagggagccaatgtggcatttctgccagctaataagtatgtctatacaaattatgcattttggcactgggaaaatgaccagaggataagtccagggacccactggaaccactgtaagtcagaaatgagctaaaactccattaattacctaacctccataagcccctactttaactggggaaccacaataacgttttgggtaccctggaatcaacgtcagctcagagccagtgtccagtactttctgaaatgtctcattacttccctttctccagtacacacagttaccctggtaaaaggccagaggtctccttagggaaggatgggagaaagagtaacagcataagttgtcagtagcctagtggtgtccttcctcaaggggatccagcctccccttcattcagtgggttctggaactgtaacaggttcgagtctggaaattgattgagggcccatgattctctgtttttataattcagattagtctttagtccattctacctggcagttttttgtttatataaatcaagtaggaatacagtaggtttcccatcaatttcacttctaggaacaccatgattaattagccaatgccagagctctacatgagtcagactattctgatggctgctttgcctctgctgtctattatggtagttatgcccaccttgcctttgatggttcagtgccaacacttggcccctgccacctcaggatccaattattcccattgtatttaaattttgtagttgagtgactgtggttcctactgttagatctgacatacagagaagagcaattacgggctcttcaaaaatacaggtgctgctctcacaaatctatttcacaaagcttcggccaagggtgtatcttctggaccctcccagctgggatgagtaggtctaaagtgactaatccactccaccatcctaatctccctaagcctttggatcacttcctctacattaaaccaaggcatttccagctcactaacattggaccatcttttaatccatatttcagctaaccaagcaaataaactattataacttttttttttttttttttggaaatggagtcttgctctgttaccaggctggaatgcagtggggcgatcttggctcactgcaatctctgcctcacaggttcaagcagttctcttgcctcagcctcccaagtagatgagattacagttacgcatcaccatgcccagctaatttttgtatttttagcagagatggggtttcaccattttagccagaattgtctcaatctcctgatctcgtgatctgcccgcccccgcctcccaaggtgctgggattacaggcgtgagccactgctcccggccctatcagaaccttttctaagtccccgagctgcaacattaaatgcagaatccctacttagtagggccaaaccaataaattcagcttgatccaactctatgtcccttccaccattatcccttacccttaatatccattcccatgcctgttctccagatttctgccaatataaattagaaagcttaagcagttcttttagagtataatgcacctcctcatgggtcacactctgaacctcacctctggggcccgcaaggaatttagcctagttataggtctagaagcattcaggggcattaggggtgcctcttgaggagaatcaacattatcttgcctggcagctgcctcagggaaggccatcactgttgcctcaagcagtgcagggtttacatcctcagacaaaggtggaaaggctaatggcagcacgggtcagggaggggatgttaccactactggggatggggaaactgtttcttctggcaaaaaagtttcatcagagttcacaaactcagtgtcctcagcttcatcagggttctcccacacatccccactccaagttccagggtcccatttttttccagtcaatgccctcactttaacagtaaacacctggcaaggctgtgcatgcacctcttgttgcagatcagctactcgcatgataacagcttgtctctgttttttcacaatttcaactctttctctacaggagttaaaactctcattcagggcaatcttagcagatttgtggctcagtatctgcttctgaaggtgggagacagatcccctgagatcatcattttctttcatctctttctccagagaacttaggagcaatcaaccaacttcattatgttccttggttctccacatatagtcaaaggtattatgtatagagtcactaaactccttgcctctcataagtgatgaatcagtagtgtcaaatgcatttattttgcataactctctaaacaattcaggccaagtactatcagtgttctccatactattagaagtagagtccttagcattttttggtctaatcatattaatcagccaacaccagaagtcccaaaaccaatgaaagaattccatccttaatattctgttcctcaagaaccacttctggtatgaaaatctgtattagtcggggttctctagagggacagaactaataggagattatatatatatatatatgagagagagagagagagagtatatgtatatatgtgtatatatagtgagtatacctatatctatctatagatatagatatactcacacaaaggggagcttattaagtggtattaactcacaagattacaaggtcccataataggccacctgcaatctgaggagcaaggaagacagtccaagtcccacagctgaagaacttggagtccgatgttcaagagcaggaaggatccagcacaggagaaagatgtaggctgggaggctaagccagtctagcctttttacatttttctgccagctttatattctggctctacagcttgggggcagcaggggcaggggcctcagggtgcttgcagggatgacacactggcctcttttccatagggtggctggggcacactggggtgtgagtaaagcactcaggatcttttttccttccctagtccaagtacagcaagggcagtatgactgcagtgttagtggcagaaggactttcagtcacctctgggagcttcaccccacaaaaacacagagtgcagccagtggaaatgttcaactgagttcgaggtgcctgcactgtgggcccaagccaggagccttgcctggtgaagagtagcaggtgaaagctcacaagaaagagaaactggaattctttccctgctgtgtgctggaggtgtcagggaagtggccaggtcccttctttctcaagcccaagggcattaacggtggtactgctgcagctgaaatggcagaggggctgtgggttgtctcttggatttcctccccagagaagcacagagccaacactgactaaaatgttcaggcagggccagggtggctgtgctctgcccagtgaggaatagtaggggcagggaccagtgcagaaaacagtgtggccacttttccataaggcagctacactgtgctggaggtccgtgagagtcctgaagctcctcgctccctcctgagcccatactttaatctcaagagtttgagataaacagtggtaaggaagaaagtacaacgggtacggctaatgaaacccaggaagataagtcaatgcgtagaagtaattccaacctaaagaaatactttttaaaaatcatatttatagaggtttgcagtgatactaaagacaatattgcaaatcattattaagaatacaagaagtacaatgtttcttgtttctttaacacctgtgatacaggtgtttgatatgaattctacgtaatggctgcattgcttcttgccaccacccaaagaaggttgtatagcactcagatgtatactaactgcaaccgtgtatctcttaggaatttctcctttgccctcttccctccctatcagcatgtatctagcagcattctgaaaagttaactgcacagtgagcgactgctgggcatcttaaggggcattcttttctacctaggtattccccctcctccactcatgtctagcatgcaggacttgggtaatctctggggtttcagattctccagacctccattctctcaggggcttccacctcctgctcatatctagctatctgcctagtctaaccataaaatcttaaataagaataaatcatgtttgctcttgattgccatgtcatgataaaaaaaataagacaccatcagtggcaactgtgttgccaagattgatgttgatctgctaatccctgtgtagaaatgaaccttggaggccattgtttgatttcttacaatatgtgcattggttgtaacactgtcactttgacagttgataagcatcttctgaatggtccctcctttagttacaaaaatgttggtgcatggatgatgttgggaataaataaaaagtgaactaaattatgttctcatcttgggcaaaaattaagcaaaaaaaaaatggaggatatgaagctcctccacaaagaaggccatttttgtactaggcttactacagtgacacaccactattagttggggagaattcagtttttccaaggtgttgataggcatccagatttcagaggaaattgtaaaaaagcagaacctgggaccaatactgcccacgatttttctttgagatcaaatctgaggcaacaaatctgttcaaaagctgctttctgcctggttgtggcaaagggtggccaagtggggctcagctgtgttcccattgcaaggctactgagcatcccctgtcctgaggctccttaggacacctggctgagcttcagcagccctcttccaagcctggagatgccagctccatctctggcacaaaatgtagtgattttcacagggtgagaggccaaaagaggctaataaaatgaagatagccaagcttccatggaattaagcaacaggacaaccttgaccactttgaggggtgtggtgggggccacatgcagatggagtgggttaaagagtgactagaagagcagtgggggtggcagcaggagagaagcctggctctgaaagcagcgagacttctagggaatacagggtcaggggaggttctgaaagatgacacactgcagagaacatgtgtttgtatgccgatgacaagtatccagtagaaaggcagatgaacagattctcattctcagaaaggcctgtcctgacctcctgagagtacacagaccatgagggcagggcaaggaggaggatgcacgctcactgtttcatgcaaagtccttggccacagtccacctgctccccacctctgtgactttgtccttcctcaatttaatatgctctatgctggaaaactggattattgaacaggcattggctgatgcattctgaacctaatccactaaaaagcacttgatagatatatcaaaatatcattgagaaatagatattttaggcccatatccatgtcttcaccccgcactgtttctcatttgaactctcttttccaggaagagttgtgcttgggtaaattctatagctcacagtgtgacttcaaaacacacaataaattaataaggtgcttcctacagtgagttcagttaaacattttgaagagtgtttttgaaatgtagcagagcaggctacaattgatattcaaaaagaggaaacttccatttatttccccctttaactaagttacctgtaactgtgtcattttattatgcttcatagagcatcactgctgagatcccctccccagctcatgttgctaggaaatatcccaaaacagaatcaatttttctttttttaacctgatgatttttccacaatccttttgtttctctgattcacctccagggctcatatggcaatggggatttaatagggtttatttgttggtgaagaaacattaaacaaatcttttaataggaaaaatacttttatattataggcaaaatgtagatgtatattgctactgaagtaaatgtattttattaatggtgtgagaatttcttcctcactgtggtgtgtgaatgtgtatgcatatttgcatgtgtaaaagacttagcaatttgtgaatagaagatgtttctccgcttctcactgagcatggctgtaaaagaaactttttcctctccccgggcattccagcacacattggaaagataacacgtccacagaaagcctggctttccaaaagagcttatcagagaatgtgccccccaggtcgattaaaacatatgttaatcctgtggcagagaagtttgttctagcctttgggtgtagcctgctgaataagttcacagtgatctacatcctagtttccatgggctgaaatagaatattcatatcccctgcactccctacacacacagacatagacaccaatttccccaaaaaactctttgcttaatcttctcctgctctgtattttctttgatattttcttgaatggcttccactaaattcaaatgtgtttgactttaaagtcaacttgtaaaattttatctggtaatttatagattaaattgcaagcatctacctccctttcatcagactctccctgcagggcaagttcatctaactatgtatgtgcttcaagatggaactcctgagttcacaggtgatttataaaccaaagcatgcccactacaaaactctcaccctccagagatttgcctcaagggacaacaccctgctcacaaaggcaccagcaggcaactgctcaactacctggtggataaggtgcccaagctagcatggacccctgaatccttgctcgcctcctctgttgccttttaaaagtgccactttctgctcctaaagtgaagtagtacggcaggactgctgcatttcttcccctaagctagctttggaagcaaatcactttctttataccagacttctctcttcttaattggattctgcaagtggcaaacaattaacctgctcttcagttacattggaatgtgtttagatttattttttcaaatgttggaacaaagatgaaaaagtgagaagagccctagattttttcttggaaatctggcttaaatccaggtttctttatttccttgatttgggaatttggtcacgagacaaataacatgattttcctaagtctagatttctttgtttataaaatggggatgactatgctaccctacctataccatgagctaaataagctagtatttgtaaaggacacacacttacattcacaatcacacacggtgtgtatgtgtgtatgtatgtataaaaatgtggggacctaacccactcaacaaataccctgagtatttgttgaatcattatatgcgtatatcatctggcaaatggatgtgtataatttctccagggataagaagcaaatgtataccgatggaaagccttactcaggccataacaaagagagaaatgctgagtcccactccatgaacaggtcaaggaaccaaacatattcaaagagttatttcattgtttcaacttgctagtgaggggagcatggcacctgaacagagatgatataaattaatgaaactgagaaccaagcgaagagcttagccatcctttgcatagttagctacaatggctatttatttttcagccagactggccatcatgtaggcacactcttttagattagaaaaatcaaccattattttttctgcccattcattccagcaccgtgacagtcttcacggggaaattaaacttatttttttaagaatttttcaatcatatacaagattttgaactgggaatttcatgaatcaaaaattaaatgaattgcacataaagccatggcatatgtatttttactacattgtgggagaaaaaataattcttataatttaaaaaaactatgtcttacctgatttcagaaataaaagaagtagaagaaccacttccttatgttccattttgggactggccagcagtgcccagaaagtgtgtcccaatcccaggacattgttgacttacatgagagtaaacgcacccacaaaccagatagtcaaattaagttaatgattctctcagagacccatgccactggctcagcagggttcaaacattaccttgaatatagagtcttataaaatatttgagagtgcaatgtcaatagatgctgggaagtggtgaaagccatttcccccctcagctgctccacattgcctttatgtctccttactccttccctcacccctagaccttcatctttcctgattagtcttgtttcctcccctcttctttcattctctttcttttggataaaataaaatcataaaagtagctcatatttgctggtaacttccatgaccagaccctctgccaagtgctgcacatccatagcctccctcaagctttccaacaggcagtgctgtacgaggagggggctgaggccttcccgaggttgtgtcgctacccaggggtgcagctgatagacacaaccctttcaggtcttagtttacgagcaagctaggtataaatgttaacatctccacatcctataccaaactgtgccgaaatgacaacataagtgaaaatcttttattatcttcaaaatttatttattcctagtgaactcacatgttttctgtaattataaattatgttataagatatcaatccttccaggagggggtggtggctcatgcctataatcccagcattttgggaggccacggcagatggatcacctgaggccaggagtttgagacaagcctgggcaacatgccaaaaccctgtctctacaaaaaatacaaaaattagctgggtgtggaggcacatgccagtcatcccagctactaagtaggctgaggcactagaattgcttgaacacaggagatggaggttgcagtgagccaagaatgtgccactgcactccagcctgggtgacagagcaagaatgtctcaggaaagaaaaaaaaataataaataccaaataaaattaataaaatatcaatccttcctattctagtagttgtggcttaaataaataaataaatatttttaaaaataaaacatagggtcgagtgcggtggctcaactctgtaatcccagcactttgggaggccaagacaggtggatcacaaggtcaggagtttgagaccagccaggccaatgtggtgaaaccccatctctactaaaaatacaaaaattagccaggcgtggtggtgggcacctgtaatcccagctactagggaggctggagtattcacttgaacccaggaggtggaagttgcagtgagccaaaatcacgtcagtgcacttcaaccggggtgagagtctcaataaaataaaataaaataaaataaaataaaataaaataaaataaaagcatagtatcaatctttccgcaaatgaattcatggtgcaatcttacattttcgttctcatgaagtaaagcaagagtggtagaattaagtggaaagagtctatctctagtgtagtcacgtcagtggttgtgtcaagatggttaggaggctcctcccgtttaaaacagtatccaagccccagttgtaaatcaattggggagacacgccaactctgatcatcagcaatatctgagctccagtctcagatattgtgtgcagttagtctctgtcctgtaccctctacctccttccctaccagaaaaatcaccactttagtccctggccaccgggacaccccaggagggtgagtggtctgaggtagttatggcacttatggctcccttgctgctgatctggaactcaagccccaagaagtccccttggatgatctgaatatacatttgggacagatctagggagtttctgagcaacacttagactggggtcttccattgattaaatcctacttgaattcgctactttgggactcaagtctaagggactgagactgagacaggagagcacaagactaactttggtctcttgatcttttcttaccttgcaactgtcaatgcctccagccaaatgcccagcacagagctcagtggatttgactcttccattcagaaactcatagcgattgcacacttcattctcaatcacagggagctgggcttccttgagaaagccagccccaaaggtacctgtgtttaaaaagatgaaagaaatggtaactacgtccacaacatgttcacaaggaaactccagaagaacagagcagtggtgatggacctcctgtctgtccgtgaggctgtagaacacaaggcagctcccaatgctgccagactctctgaaccctggagagtgtaaacgtcatataagagtctatgttccaaaaacctggatttaacaatctgagctttgtcatggtgctttgcggttggttgttgtttctttacctttttctttgcttttaaaaccataaagaataatgtttaaatgtagagtctgagaaatgcaattgctattgtttttatattttcagactttttgtatgcttctttcactaattacatcatatcacaaaatttcacaccctgattttttcactcaacattacataatgagttttgtatagtgctatgatcttcataactaatattttaaaggagagctactgattaatgagcatgaggtttcctttggggatgaggaaaatattctggaaatatgatgatggttgcacaccactgtgaatgtactaaatgccacttggtggtaccctgcaaaaatggttaaaatagtaactcttacgctgtgtacattttattgcaataaaaaagaatagtcatcatttactaagcattatcctttccaggcacaagcttataatgtggtgtatctcacttcatcctcacaacagtcctatgaaacaggcagttccatcactcctgctctacagttaaggaaactgaggtgtaaggaggttgtctagttcaacctgagcctgggtctgcggagtcactgcccaaatgcttcctccccgtgcgcgttggcccccctcttgcttccaaccctccacatctttgttcataaagttcattcttattccttaatattttctgagcctaagttcccataaattatatagacatatttctgtctcccaataacactgccaatttattttctagaaggttatgacagtgtaaaatgtcactagaaaacaatcacttcaccacacttgtatgagtgttcaatttttaaatattagctaatctaacaggttgaaattgtcctgattcattttctaatttatacttctttgacaatttgggagagtgaagattctcctggttgtgtttattcttttgtgaaaaactgctttattttctttgccaaattcaaatagaacggttgcaaaattgccagaggaaatgctgtttttccagatggacacacccagggatgtttcagtgttctcacaaataatccagttttctaattttgcaagcccagctttcattagaattttgcaaaaatccttgctttgcgagcatggcacaggcaagagatgaggcactctctctttcttcccccagagcctttgactgcacttagatcattgactttggttcagaaacctgactgcatctggagttgacatgagcagcatggaagatgtttgtcccagcacctcactccagaggccagctcagctcaatctgggcagagctgcatgatggaagtttctgactaccaagcatcgggcagagggtgcatcacctggactacatagttgtgtgagggagcaccgttctctagaatctgctatttgagcaaggcaaacatcctgataatggtgaaaacctaccgcaagttgccaggaaagttgatgtggtctgcgagtaggtgctgccatccagtggccgacatagagatgtcatctctgagggcaggtaggccacaggtgacaagaggattgaagccctccctgatggggccttggggagagggcagcagggtaagtccagcggcaggatcagtccattgattgtggatgacgactgacctggaaaatccccttggcctcaacacctccaaactctgcatttgatccaagtcagggaacacctggaaacatgaaggggagagcaggaaaactttgacctccctctcagaggctgagaacgccaattgacctgatgtcattattgacatgtagaaaattgatgaacaggcctgagttatgttttgtggcacctcatggtctagttagtgttctgagaatcattttctcagtggacctgcaggtgagaccaggcgaggcagaagcctagtgggggatggtggttagaaatgtgtggatggttgtggggcagaagaaacagcaagtaggctctgggccagctacaaactggttatatgatgtctactgatgatgatagtgatggtggtggtggtggtgatggtggtggtggtaataattgtgatggtggtggaatgatgatgatggtggtggtgggtagtaatgatggtgttggtgatggtggtagtggtcgtggtgatggtgatagtgatagtgatggtggtggtaatgataatgctaatggtggtggtaatgataatgattatcatgatgatagcggtggtgatggtgatggtgatgataatggtgatggtggtagaatgatgatgatggtgatggtggtggtggtggtagtaatgatgatggtggtggtgatgatgttgagggtgatgataatagtgacagtggtggtggtaatgataatggtgatggtggaatgatggtgatggtggtggaatgatgatggtggtgctgagtagtaatgatggtgatggtggtggtggctgtggtgatgatggtggtggtagtggtagtaacgatgatggtggtggtgatgatagtgatgatggtgatgatgttgagggtgatgataatagtgatagcggtggtggtaatgataatggtgatggtggcggtggtgatgatgttgatgaagatgataatgggagtggtggtggcaatgtggatggtgatgatgatgttgacgatgatgatgctcatcacaatcaccttatatgttagtacaggtaagaaagccaaggctaaaagagattaaataactgcccaatgtcacatggaagatggtagagccagaattcacacccagatccttatgattttagcttggtgctttcatcagttgaggtattggagaggatctgtttgctttctggctgcccagcagtctatcaccctacatcccataatcctgttgagggatccaccctttgcccttctgggtatgagtggggtcctgcctccacctctagcatgtaatagctgatgcaggttggagccaatcagtgatgggttcagggacaggcctgtgacccaagttcaacctctcagacctggccaactattgttcacttaatggggacagtggccttcctcagtctttcctggcaaagcaagagctgccacagcatctgccaccacaagaatctcacctttgtgcccaaggatgatgcctactgcatggctggacagggcctgggccctggggccatcatgtgagcctaaagacttttcagctcaacaagaattccccttttttgcttaatccatcttaagttggattttctgtcacttgcaagaaagagtcatgttagatacaactctattctgtatattagtaggagctgccatgatggagtgcgtagcacgtgctcgacacttgatgcacattcttattgtttctcccccgacaaccctgcagcccccatttcatataagaaaacaatcaatgagagttcatgacttttctaagtcccgacagccagtaagtgggaaccagggttccaattcaggtctccctgtgccatcctgcaccttctctgagcctcaggttcctcacttgtaaaataggaacaataatatctaagtcttagaggtttgcagcatttaaatttttataagtgcaaaacactgggagcagcctggcacacccaaaggtgttcctcttttgccaagtttccttttagttggcctcagtgttcccagactcaggagtgcagaaagggggatcaagaaaccaaggaggatgacattttaaaaatagtagaaaaagcacagaaaaaggaaagcaaactttgcaattatctagaccagtggtttttaacctttttgttaaacaaaaaacaaacaaacaaaaacctttcttcaaatgacagcttatgcaaaaggctgatgtggaaaacaccacttgaaaatgctggttttacaaatgaggggttggagtcaagtcatacaaagagttaacgtgcctagtccaggtctgtctggctagtggcagagtcagaacgcttttctagggctccagactcataatgtcctcaccagcacctctgagaaagtcagcagagtcagaacgcttttctaggttccagactcataatgtcctcaccagcacctctgagaaagtcaggcagagatcccaaaacagtcttagtgttccagtggtcaagggggtaagtctgatagatataattattgtcagggcatactgaaaaatgaagaaggaatccctaagatgtagtccaggtgctgataccacatcctgcacagatgttccctctctttctctcacccatcaaccaataccaaatactatcctagatttggggccatggggcctgtctgcctctcccttagctgcaggtcccctgcctaacaccctcccacacacattagacatgtggatttggtaagaaggctagtttattataacttttgtcattattgttttacatcatgtttagaaatacaatctggctaatttcacataaaaaataatctaacacccttaagggctgggtgaaaaccccacttacctgaggaagcaatatgaatgctggagttatgaattcagagactcaaagacctttactggttttctgcttgttttaggtataaaggaaatacacaatcattaaaataaaaaatggatcacaccccaaaacttcaacagcaaaactattttgctaacatgccccactatgaaaccaaagacaagaagtcagctacaaataaagaccctgtacaaggccttggccctgtgaaaacctccaaagaagaagtctattggctgtactcaatctacactgcagttaaagaaacacccacacagagacatgagaaagaaccaacgtaagaactccaataaatcaaatggccagaaggtcatatgtcctccaaacaactgcaccagttttccaacaagggttcttaacaagactgagctaactcaaatgacagaaatataattcagactacggatacaaatgaagatcatcaagatttagcacaatggcaaaatccaattcaaggaaattaaaaatcacaataaaataatatagaggctgaaagattaaattgctggtataaaaaaagaacctaacggatctgacagagctgagagctgagaaacaaactataagaatttcacaatgcaatccaagtattaataggagaatagaccaagctgaggaaaggatctcagaaatggaagactagctctctgcaatcagacagttgacaaaaatgaagaaaaaagaaggaaaatgaatgaacaaaacctacaagaaatatggggaaaaaaggccaaatctacaaatcattggcatctctgaaagggatggggagaaagctaacaatctggaaaacaatttaggataccaaccatgaaaacttccccaatcttgctagagaggccaacagtcaaattcagaaaatacagagaatccctgccagattctacacaagaagatcatcccaagacacataatcatcagcttttccaaggtcaaaatgaaagacagaatgttaaaggcaactagagagaaagggcaggtcatctacaaagggaaccccatcaacctaacagcatacctctcagctgaacctctgcaagccagaagagattgtgggcctatattcaacattttaaaatatatatatattcagccaaaaatttcatatccaaccaaactaagcttcctaagcaacagagaaataagatcccttttagataagcaaatgttgagggagtttgttaccaccagacctgccttacaagagatcttgaaaagagcaccaactatagaaaggaaagagggctactagccaatacaaaaatacaattaaattcacaaaccagtgacactataaagccaccacacaaacaagccagcataaaaacacaatcagagcatcaaattcacacataccaatacttgccttgaatgtaaatgggctaaatgcccaacttaagaggcacagagtggcaagctcgataaaaaagcaagacccaattgtatgctgttgtcaagagaaccatctcacatgtaatgacacccaaaggctcaaaataaagagatggaggagaatctaccacgcaaatggaaatcagaaaaaagcaggggtggcaatcctaatttcagacaaaacagactttaaaccaacaaagaccaaaaaagacaaagaagggcattacataatggtaaagggttcaattcaacaagaccaactatcctaaatatatatgcatccaacacaagagcacccagcttcataaagaaagttcttagagacctacaaagagactgagatgcccacacaataatagtgggagacttcagcagttcactgacagtattagacagatcattgaggcagaaaacttacaaagatattcaggacctgaactcaacattggatcaaatggatctgatagacctccacagaactctctacccccaaacaatagaatatatattattctcataatcacatggcacattctctaaaaatcaaccacataattggacataaaacaatcctcagcaaatgcaaaagaaccaaaattataccaaaaacaccctcagacgacagctcaataaaaatagaagccaagactaagaaaattactcaaaaccatgcaattacatgggaattaaacaacatgctcctgaatgacttgggggtaaataataaaactaaggcagaaatcaagaagttctttgaaactaaagagaattaagaaacaacatactggaatctctgggacacagctaaggtagtgttaagagggaaattcatagcattaaaagctcacatcaaaaagaaagatcccaaagtaagaacctaacatcacaacttgaagaattagagaaacaagagcaaatcaactccaaaactagcagcaggcaaggaaaaccaaaatcagagttgaaatgaagaaagtcaagacatgaaaaaacattcaaaagatcaacaaatccaagagttggttttttgaaaacattaataagacagatagtttgctacctggctaataaagaagaaaagagagagaagacccaaagtaacacaattacaaatgacaagggggatgttagcactgaccccacaaaaataaaaataaccatcagaaactactacagacagctctatgcacacaaactagaaaatctagaagagatggataaattactggacacatacaccctcccaagacagaaccaggaagaaattgattccttgaacagaaccacaatgatctccaaaattgaatcagtaatgaatagcctactaagaaacaaaaggccaggaccagatagattcacagctgaattctaccagatgtgcaaagaagagctagtaccattcctactgaaacgtcaaaaaaaattgaggaagagggactgcttcccattttattctatgaggccagcatcatcctgataccaaaacctgaaagagacacaacaacaataaaaacttcaggctgatatccttgatgaacactgatacaaaaatcctcaacaaaatacttgcaaacctaatccagcaggacatcaaaaagctaatccatcatgatcaaatagtcttcatccctgggatgtaagattggttcaacatatgtaaatcaataaaatgtgactcatcacataaatgtgactaaagacaaaacccacatgattatcttgatagatgcagaaa

SEQ ID NO: 1134 - DNA, 104853 bp, Homo sapiens
ctttaattgggtcttccattacttgctgctaaatgcatccctaactaagaccatggtgaagctatatcgccacaggaaatggagactccagggtgggctgcctgcccatcctcccactaccacccgccctatacacttgagagaataagcgatacctcattaaaggaggaatgttctcaaggaaggatcaggttccagacaagccaagaggggccaggataatgtgagccaggggtggccccaggcttcaagcaaggagatgggtggagagcagtataacagtgttaggaggaggaaggactggacttagtggagaaggatggatgccaatcaaggcctgccaaggatgacaggatgtgagcaatggtggagtcagctgatctcaaggcttcaaatggagccctcaggctgtcagaggcttactgtggccaaccgacctttacttcacagaaggacaagttagccatcctggtgaatgggcaaagtcaagcagctctggatggagtcagctgtggtcaggattgtgcctctgcaaggaaatctcagttctctaattactgtcttgcctctctcccttcccctgtgcagccaagcatcttgggaaaattattcatattcagtcttctcttccttacttcctcattacactgccagctggctgctgcccccaccagtcatgaaactgtcctggcccatgtcacatacaccctcctaggggccttgaatgatggcacattcctgtctttctcttgctgggcctttcagcagtactcaacactgttagccattcttgagtaagttctcccccaactacttttcatgattcctttcttggtcttcggcctacctctctgcgtcctccctctcagtctcctgtcttcacgggacactctttctgtgtgatctcatccacatctgaggctccacagcctgggcaaggctatgtagtatggtgattaaaaccttggccgctggcagaccacctgtgttcaaatctctgccctaccaggtggttgctttgtaatacccaaacttctatcaagatgtggatcattaccctcaccccaacccacaggggaagccactgttctgatttttttttttaagtagagtaatataggatgtagttttatgtctggcttattttacgcaacatgttttgaggttcatccatgttgctgcatgtatccatagttctttcatttttcttgctgagtagtgtcccatggtggatctataccacagtttgtttatcctttttcaaatgaaggatacctgagctatagccagcttttggctactgtgaagaaaactgctatgaatattctgtgttcaagtctgtgtgtgaacatatgctttcatttctcttggataaataactaggaatagaattgctgagtcacagggtaggtgtatgtgtagttttataagaaactgctacatattgttccaaattgatagtacattttacattcccactaatgatgtatgagagttccagttgctctgtattcccactaacatttggtattgtcagttttttaaagtttaatcattttggtgagtattgagaggtatcacactatggatataatttccttttttttttttttttttttgagacggagtcttgctctgtcacccaggctggagtgcagtggcacgatctcggctcaccgcaagctccacctcctgggttcatgccattcttctgcctcagcctcccgagtagctgggaccacaggcgcccgccaccacgcccagctaattttttgtatttttagtagagacagggtttcaccatgttagccaggatggtctagatctcttgaccttgtgatcctcctgcctcgtcctcccaaagtgctgggattacaggcgtgagccaccgtgcctggcataatttgcattttcttaataactaaagatgttgagttcttttctttttcttttttctttttatttttgagacagggtctcactctgttgcccaggctggagcacagtggcacaatcactgctcactgcagcctcaaccttctaggctcaagcaatcctcctgcctcagccttttgagtagctaggactgcaggaatgcacctccatatctagatcatttttaaattttatttatttatttattttgagatggagtcttgctcttgttgcccaggctggagtgcaatggcacaatctcagctcactgcaacctctgcctcctgggttcaagtgattctcctgcctcaacctcccaagtagctgggattacaggtgcccaccaccatgctcagctaatttttgtatttttagtagagacagggtatggccacattggccaggctggtcttgaactcctgacctcgtgatccgcccgcctcggccttccaaggtgctgggattacaggcgtgagtcaccacgcccggactttttgtagagatgaggtctcgatatattgcctaggctggtctgaaactgctgacctcaagcgatcctcccaccttggcctcccaaagtgctgggattacaggcgtgcaccactgcacctagcctcgagtacctttcatatgcttattgtccattcattgggttgtcattttattactatgttataggaatttttaatatatctcgcattcctctgtcccttctcagatcaatgttttgtctatctatttggcttacttccacattttcataataatgtcttttttttttgagtcagggtctcactgtcactcaggctggagtgcagtggcacaatcaactcactgcagcctctaactcctgggctcaagcaatcctctcttctcagcctctggagtagctgggactacaggtgcacaccatcacactcggctaattttttaaattttttgtagtgacagagtctagctttgttggccaggctggtctcaaactcctggcctcaagcagttcttctatgtcagcctcccaaagtgctgggattactccataatgatgtcttctgacgagcaaaagttttctattttgatgtttcacttatcaagaaatttatgttattgctttctatagcttaagaaggggttgctttcctccaaattatgaagatattctgtgtttttgtctaaaagctttatgattttagcatttgtggtttaggtctataatcaatctttttttttagacggagtctcgctctgtcacccaggctggagtgcagtggcgcgatctcggctcactccaccctccacctcctgggttcaagcaattctcctgcctcagcctcttgagtagctgggattacaggtgcccaccaccacacccagctaatttttgtatttttatttttttaattaattaatttttttgacacagagtctcgctgtcactcaggctggagtgcagtggtgtgatctcagctcactgcaacctccgcctctcaggttcaagcgattatcctgcctcagcctcctgagtagctaggattacaggcatgcaccaccatgcccagctaatttttgtatttttagtagagacagtgttttgccatgttggccaggctggtcttgaactgagctcagatgatccacccgccttgtcctcccaaagtgctgagattacaggtgtgagccaccatgcctggcctgttaattgtgtatttttagtagaaacagagtttcaccatgttgggcaggctggtcttgaactcctgacctctggtgattcaactgcttcagcctcccaaagtgctgggattacaggtgtgagccactgggcccagcctataatcaatcttgaattaatttttgcatatggtgtgaggtaggggtcaaggttcatttatttctcccatatagatatgaagttgttccataactatttattgaacagacattcctttctccactggctggctttgacatctttgccaaaatcaaatgacctttacagtgggatcagccagttggtgcaatacgaagtcccgcctctcatcccctcacagaaacacagatttaacaatttactgatcaaaatacctttatgagaagtacagaatccggttgagaagtgtggtaccccagacaagtagagagctgagaaaagctgcactgagatggatcctacattcctgggtctgggagtgggcctttcccagagataccatcctccagcagtaagagacctccaatagtcgggtctcagacaggttccagctaagagtaaaatcccagatcaatggtgaaaaggagtttaagaatggatgctgaagccaggcatggtggcatgtgtctgtagtcccagctacttgggaagttgacaggggaaaatagtttaagcccaggaggttgaggctgcagtgagctatgatcataccactgcactccagactgggcaacagagcaaaactctgtctcaaaaagaaaaacgaagcctgtgcctagtcaacattgaagcaagaatgcagaagttgcacagggtgagatagggatgagcagggtggaggggtggtaaacacaaaggaattgcaataagaaatcaaacaactatctgattttttaaaattatgttgagatatttggggaaaatgatagatgcatagaaaactaatcaaacgaaaaataattccaagataaaagtatataaaagtaacattataaaataataaacgcatatagaatttttattaaaaaatcaaatgattgtgagtctatttctggttctctattctgctccatggatctgtttgtcaattctcatgctagcaccacatagtcttgattactgtcacttacaagtcttgaaatcaagtagcataaatcctccagcattgattcatttatttttctttttgagacagggttgcactctgttacccaggctggagtgcagtggcatgatcatgcagtgatcaggttcactgcagcctcaacctcctgagctcaagcaatcctcccaccttagtctcctgagtagctgggcctacagatgcatgccaccacagcactgggatttttaaaaactctccaggtgattctaatgtgagccaaattttctagactcagatttctctgtcactatcttcaggcctatacagttaactggttagtatactagatcctacttctttattgtttctgaatcctcttcctctccagctccatcactcatgcattaaggacttcaccaatttctcaactggctctacactacttctagaaaaaaaattctaagtccttactgtggctaaaatcacgctttgtgattaggctttctgatacttcatccaacactctcccctcaaagtaccttaaacttcagctatgataccatatttgatgttcttcacatgttttaaacttctcatgcctccaatgcctttcctgccatccagcctaaaacaccctttccttttgttattggttgtcattttcttcctctcattcaacatttagcctggcatcatctgctgctctctgtcttgaccaccttgtctggaagaggtatccttcccatgttcccatgcccttctgcacatgccttcatcacaggtgttaaggaactgactgtattgtcattgtctgtctcttgttgagcacccagctaacctgaaagcttcttgaaggctgagactgtgtgtttccgtctcttatccctagtgcctagcaatgtacttgcttatacgaggtacctaatatttttattaagtgaatgaaatctgggcttggatctgcaccattatttgggacagattctttaatctctcagaacattctattttcttatacacactggaaataacacccatgacaaaaggtagacttaagtgagctgatactgtaaataaagtccactgcgtgggcctgggacatggtatgcgctcaataaatactggtccttttccctctctccgcctgccatcagacctttccgggatacccttcctacgcacacttccttaactgaccactaggtggtgctagcctctggcttgacattcagttccagagctacccaattaacgccccagcccaggccctgctatactcagaaaaggcgggtattttgtaatttgctgagcgacccgaaaaaagagatgccctttacccacactagcttctttgccctcatcaccattccaggtatcaatcatgaatttcagagaattcctccatgattccctactattatggttataatctcaacccaaggatttgaagatgcctcttaagaacagatgtggggaggaagagaaggcactgaggcagagaggattaaacaatgaatgctataagagaaatagagggaagaagatgcttgaagtcacatcctgttccaggaaaggcaactctagtcctaacattcctttcaccaatcaagagcctctcacgctgggtggaaacgaagaagaaaaagacatggtccctgccctcaaggagtatatagtctagtggtggatacagagcccacaaaataaagtgctaaactctggatactgaagctttcctgaatacaagtttggaacaggagagataggcagagcgagaataacaggagggcttttctgaggagggtagaggagcaggggaactgtatcattaatggctcagatagaaatatgcattctcagcagggtgaggtggctcacacctgtaatcacagcactttgggaggccaaggtgcatggatcacctgaggtcaggagtttaagaccagcctggccaacatggagaaatcccatctctactaaaaacacaaaaatgagccaggcatggtggtgggtgcctgtaatctcaactattcgggaggctgaggcaggagaatcgcttgaacctgggaggtggaggttgcagtgagctgagatcacaccactgcactccagcctgggcaacaagagtgcaactccatctcaaaaaaaaaaaagaaagaaagaaagaaagaaagacataaatatgcattctctcaccttacagacataccctcagcagttcacctgctggaaataacccaagtgcccaacaatcccaacaaactgtggaacatccaagcaaggagattccaagtagccaagatcaaagggtgagctaaatgcgttcatacggtatggaaagggatcaagctaagttaattgaaaaaaaggcaagttacagaacactatatatcatatgagtttctttatagttttaaaggatattcacttatatttgtatgttactgttttatttatttatttatttgagacagggtctccctctgttgctcaggctggagtgcagtggcacgatctcggctcaccacaacctccacctcctgggttcaagcgattctcgtgcctcagcctccccagtagctgggattacaggtatgcgtcacgatacgtggctcatttttgtatttttagtagatatggggttccgccatgttggccagtgtggtctcgaactcctgaaaagtgatcctcccaccttcgtctcccaaagtgttgggattacaggcatgagccaccacgcctggcctgtatgttactgttttaaaaactctcctggccgggcacggtggctcacgcctgtaatcccagcactttgggaggctgaggaggccagatcacgtggtcagaagttcgagaccagcctagccaacatcgtgaaaccccatctctaccaaaaatacaaaaaaaattagctgggtatagtggcgtgtgcctgtaatcccagctacttgggaggtcaaggcagaagaatcgccgaacccgggaggcagaggttgtagtgagccgagattaggccactgcactccaacctgggcaacggggcaagactccgtcttgggcgggggggaaacctctgctggtaggggagacctgaagaactgttagtagaagttactctgagggtgcagctgaaaaatgggggtgtggagagcatcaagtttccttttactttttaccttcctgtactttttttaaccactaggtattatcttttctttctttcttttttttttaacaatataaagttaataaaaatacacattcacattcaggagacagcaggggatgggaggttgcaagtgagaagtgcatgctgactgaggccaggttttggaaagccatgactgaagaggagttcacatttgactggtctatagacacccactagaggttccccagcaaggaagagacaccgggaaagcagtttttggaagattcacctgacagatgggtagggggagggaggaaagccccttcaagccctcaggctacatgtggttgctccagataccgttttcctctcaaagctgtcaagctgtctaaagtctgtttcgacctgatttcacttggatcccaatactgggaggggccctgggaggaacctcgtaggcatttggtgagtccgcatagtgcgtctcacattgtgttgggccatgggagctggataaaaggagaaataagaccccgttcctgcctggagcaactctctggcagtggaaatggaggaaatctgagatatacttcagaggaaaaaaatgacaagcctggagcacaggctggcaagattggatataggaaggaaaggcccccttgagttggcataaagtctgaggtttctagcccaggagactaaaggcaggtggccaccgcgctgagcaaagccggctggaagaagctaaaggttgagctcactgtcattaggaggcaagtccttcgtgctgctcctgtttctgccaaggacagactggagtggggacttttccgtaactagaacgtaaaagggggaacagtccctcctctccagcgtcaatttttggcagccgacgtcgtctgccccgctccttgaactctgacatgcagacacctagaaagtcagacactaaggtaacagccataaaacgccgcccagaagggggcagtgaccaaaagcacgttcactggcccctgggaaccgcctggcgcctgccttctgcaaagtatcattcccgtgtgggctgagcctggggacaaaggtccggcgctcagcagacacctccttggaacccgaggcctggaaacgaaggtccagagtccctcatcttattccaaatcctggcgctcggaatctaaaaccctaacttgatggcaagccagtcagaaggtattaaaaaaaaaaaaaaaaaaaaaaacagaaaaataaatgagccccgacttcttgggcgaaagggggtggcctttcctcaaccccacccgctggtgactcacctccctccaaaccagggcctgcccctcccgcgcctagggctgggcgagcagggcgggcgggtactaaggtgggctccatccccgagccccacgcgggcggacaagctccggcgtgtcccctcgggtgtccctgtttactccgagcccgggagcgaggtgggggcgggtcctcgcggtccctccccaaccccgccccctccttcgcaggccccaatcccagtccggtcttccaaagtctccaaatcaaagctcagcctttccctgcaccttccccgcggactggcggtccctgtccccaccccgggcagaggaggcaccttcagggttcccctagaaaatcgagcctcggcccagaccactgagtcccggacgcccccggagggagcctgaaatcctagagtatgacactgagtttcaaaggggagccgctcagctctccgcccactgcccaatcccaccctcgaccccttctgctctctggagcaccagggaggagggcccagccaggggagagggcgccccaggccccaaactagccagcgagtccccgggaccctcactcttggaccgctttccagaactccgaaccctgtcgcgggtccgcgtcgccctcccccgggcagcgcgtcaaatcggcgcatgcgcactcactggattgccgcgtagctctttctccccccacccaccaaccttttttctttccccgccccttccctccctccctcctcaacccgtcccctccctctcccccatcagcccccccctcggcacttcagtccggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacggtgagtgagattccgcgtcccccttggacccctgggggcaccctctccccagcccccactcctgcatacggatggggaagggagacgcgggagggggtgccttttgttatcccagtccagctgacacagcagcggcccgactgggggcggggatggggtccgatttgggggatgggggccctgggcaaatgatgcttccggggccccccagcacaaacaaagaccagaggcctgggtagagagaagagggctccccatttttctgatcctggggaggagaggccttcttttcctatctctgttcggggagggcctccgcctcccctacatcctcacaaccccccaccccccatctgaattgtgaaggaatccggatttgcaatgttcggctgcaaaagggggtgggggtggggggggtggcttttgcactggcctctgtagctcgaaaggggagccaggccaggggtaccctgccgggcagagggcaggcaggcccgggaaggctgtgggtggggagagggagggccccctgcttgggcgtggaatcgaccccagagccccggctggaggcctgggtgctgaagtaggctcttccccctctcagggcctctgtcagtagcctggggtagggctgtgttggggggcagagagggggagctcgccatactatgtgactttgaattttccttcttaattcctgggagctttgagatgaaaaaacgtcagatgtcatcactggggaaggggactggagaatggcctggaatgctggggtaggagggtgggggaggctgccttcttcctgacttctggcttcatcacagtttggattggaaggagagttggaggttggatggggattatggctgtgcccccacactcctttagtaaatctgtttattccctgcacccctccaagcccaaaaccccatacacacacactttgtatattgcagagttaggcttaggctagaactgcatccttttggggaaatggggtgcctctcttccctttttttgtcagctgtttttttctcctacttgtgagtcactggttcaagtcttgcccaagctttaagcattaagctggggtcatggggttgggctgggctaggtccctgatttgagaaggggtgggatctcatcccctcctgtcatcttagccctctcatccaaagacaaaactgggctggataccatcatacaccccctcctctgtcttgccagattgggattgggaaagtttttctctgaaaccagattatctccctccctctccctaacttgcttcaattgggggaggagacttacagggtcaggaagcagctgtgtccccaaaaaacatatttagtgtccctcagttgtgccatcttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctttggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgagagaaagttctaaactcctttctccctgatcagactcacatcctaaacgtctccctttgcctcgttgtcttttaaagcaagaatgtgtaagaaattcattttggggttggagggatattttgatgtttagggctgcttcactagacatctttttcttctgatcttgttctctctcctctcttcattttctcaaccacccttccaccactgagcctcccaaaggatgacagcccaggtcctggccagagtcagttcctgtccagatgcccccattcttcaaaaccccttccttaccttttgggaagcccttccttactcaagtctatctctctttcctcctgctgcagtgtgagcccttgcacatcagaacccccaagcctaggtttattcccgcccagtactctcttctcagggtcctcctcactcctcagactctttacctttcaggtcctccagctctgcgtgtgggctcattgctcttggggcatctgggtgcagctgaatggtactgcaggaaggcccctgacttggtagtgctgggtatgagcgatagagaacctgcctccctcttctgtcccagatttcagcctggttagcaggatcctgcattgtttggagaaggaagcagttggctttggagtgtttccggtgcaatggcctcaggcaccaatataaaccctccctgggaaagaggtgaggggtatatgtggagagttgtccctcttgctcccctaggggagatgaaagcctctccctctcccaccaggccttagcttccctggctgaagagctccattttcctccctcctttctaccctcctgactccaggggtggtagtggtccctattctgggtctcccttgagtcaggcactgcctagggccgagactctgtctctccaagataggacagatcttgctcccaccctactctaggctcagcggggtagtcattctctgggttcatcccaggacaactgtgtcatccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctggctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaagaacttggagcttttactctggtgagcataagctgtgtgtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccactgggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcagtccctgagtctccttgtcctttaagaagcacctctaaggtcttagctctcttccttgctctcgctccctcaagggggtatcaaaggatgggttcccctcctctggagaagactccttcagggttggacttcgctgtcaccctctctggccaggcattctcaccccacttccccacccccaaggtcccagaatgggacacagaatgacagccaagggtcaagcagggcagtggggtctgtgttgtgtctggacgcacacccaactctacacctcctgccctggctccagcttggtggccctggggaccgtggctgggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacagcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacggggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaaggtgaaaaaggttagctcccatcggtcagggagacctccgggttctctcatgcgggccaggaggcggggaaggccttagttgcttttgaccttagggcaatgttgttctctcatctaaactgcaggccacaaaggtgggttttctgggtgctggattcagacacagaaggctctgctgaggggagtggggttggctttccctctaagcagattataagggtcctaccccgctcccaactcagctctctcccagctctgagtgaggcttcccttggctgtgtagactgtcccaaagtagtttatttgtttctttcttccctctccccctgaaggaaatcaaagacaggcctcagccttctcgctccagattcctgggcccttcaacaccagccctgacaggaagttctttcacgtatctctctgcaatccttgtgctggccaggccctcgggagatgtggccccctcccccggtgctgctgtgggataggggcctgggccctcctcttcctttcacttgtcccatcccccatcccctccctgcaagagcacatctggtttgtgaatctctctcattccagcttttggagtttgccagctgctgtttcctctgtggagttcaggccaaaaatgggggtgggggacagcgggggggactcagtgagggctaaaggagggggcaccatggctgggatgtggaatggaggggaggttaggtgaccacccggtgacctcaggccgtggctgtgcgctctgcccctgggaggagcagggcatggaccaagtcccaggtgggtggcacgggggtctgtttctgggctccaaacatctcatctgcctctgagtcccattccagcccccctcttccccctcagccggccacggctggtcaggggaagcggacggttctccggcatgctaactaggctggcgggctgtgtttcccgggaagacctcacagctggcccagtggggcaatgaactcagcattatccacctcctcaaggggcctttattccaggctcagggtgggggccaggggagggaggctgaagggggagcctggctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggccttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggttgggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaagaagcctgattggggtgggagggtagggccaagaggtcctgaatatagtagctaactagttggactggactgaaaccagttcctagagttcatttcagccatccccctgcctctgctccccaattctgatatcttgaaaatctttaggtgcttcttaactctaaggatgtctactgaaagtctccctgaggtctaaccaagggaggctgtgtctttagagaatggagaggacaaggcaggtggatcacctgaggtcaggagtttgagaccagcatggccaacatggtgaaaccccgtctctactaaaaatacaaaaactagctggacatggtgatgcatgtctgtagttccagccactggggaggccgaggcaggagaatcgcctgggcccaggaggtggaggttgcggtgagctgagattgtgccactgcactccagcctgggggacagagtgagaccttgtctcaaaaaaaaaaaaaatagggaatggaaatggaagcaaggctctctaccctgcccattcctgcccagccttgccctcctgtgcctctgctaataccatctccaactactactgtgtgtgccaagggcatccctccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacttttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcacccccacacttttgaccctgatgcttgggcgttagaagtaaagaaagccatgcagaagggtcagatctgcctctttttgttcattcttccttcaatttgctgtaaacctcaccttatatgcattaccactctgttcacactcataccccccggactcataacatcacacacagacccacctggcactgatgagcccacctcccacccaaaggcacaaacacattctcacagtaacacagagtcacactcaaatgtggatgcagaaacacactctatactcagagagatgtccccagacacacataccaacatagagacacacacacacaaacccagattgattcacatggaaactcactgaggccagatacaccagcatacagaaagacacacagatacactctcactacctaccgctgcatgctatacagccacaccatcagttgtgtaagcagactcccatccaggcacacatgggtcatagacactgtcactcacacaccgtgtccaggcttgggggccaatagacagtggtctctctatctcatccatcctcttgagcaacaaaggaagttgcagagatgatatgaccagttggccacaacctttttttttttctttttttgaaaggtgggatctcactatgttgccttggctgatctcaaactcctgacctcaagtgatcctcctgacacagcttcccagagttctgggactataggcgtgagccaccatgcctggccagaccacaacctttgattcttcccaaatccttctatcaggcttgttgctgtggggttggaagtctagaatagtgctgtccaatagaaatgtattgcaagccacatgtgctattttgaaattttcgagtagccacttaaaaaaggtaaaaatgaacagatgaaatgaatttgaatattttatccaatggatccaaaatattatcactttagtacagtgtattcatataaaacctttagagatcttttgcatttttctgacattaagtcatcaaaatccagtgtacattttatacttacagtttgaacttgccgcctttcaagtgcttgatagccacatgtgactgggctacgtattgggcagtgaaggtctagaagatttggcaccactcttggccctgggttctgcaacctgggagctatgggaaggagtttttctttatcattggagtttctctgccatggaccctgcttccctcagctcatcaaaacctttttttttgtttgtttgttttgagacagatctcgctctgtcgcccacgctggagtgcagtggtgcaatctcagctcactgcaacttctgcctcctgggttcaagcgattctcctgcctcagcctcccgagtagctgggactacaggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaacacagggaggagcagaggtgctgtgactaaagcttagccatctagtttagtccacctgccgcccctacgggtgccctagaaggcatcccccaggagctgcagatctttgaggggccctaaatctgccttggtccctccctctctgacagtctagactgtctgaggtggttgataggaaagccatccaggccgaggtgggaacattaggatgacaagtcagactgcttccagcctgtggctcaggtcaccagctctacagtctttcccccaaagggccctgtgggccatggagagtccggtcacagcgtgagcatttaagagtcgtgtccggggaggcagagcctcaagcctgcgtgttagggaatagtggcttctcccttctcttttcttcggggtctgggcccggagcaagaggccagctttgagaggccatgagcgtagccctaggggaggggctgtgcttgggtgtgggggcagtgtcctgtgctgtgtgcctgagaaaacatctgtctgtgggaggagactcatctggatcctgttcactaggagcagggaggatggagcaaaggagtttgtggaagatttttctccctttctttggttgattttgcatgttttcatctgaagctcctgggacgggatgcagaatgcgggcctgggggctgacttaaatgaccacgcgcaccccttcctctcgtgtggtgtgtgttcaagcttacttccttttgagtacctttacagtctctaaaacaacagagaacttcaaaaacctcaggtctgaatttccttctctgatattacagaaatcggcctcctcattccctcaccctatatccagaaaagttactcttttctaggttttccagagcaaatgatattttccccctctgtggagaaaggctgggcaggcagcatgaatggctctcgggtggaagtggggaggagaaagaatcgctggggcctggccccccatcccaactcttcctggcaggcttagtgcctctaaacgtcttagcatcttgggcggctctctctcctaggtgggggtggagtgggaagccagggtgtgaggccgctggacaaaggggtctttgtggccaggctgcctggccccacgcaaggccattaactgggtcgctggtctgggggggcaactgctctcccacctctcccccctcctgtctcattcccttctgtctcccctgtggaagtgggtcagtggcaggagaaagattagaaaagaatccagaggggaccagttttgctcctccttcctgtcctctacctgggccttaggccttctctctgaggcctctagggctccggggatgggttagacaggtgcttccaggccagagctgggatcctgtggggacagacacgattccatgcccacttttcagccccagctgaagccaacattgtaatccccaggcagtgtagatgagaggcatatcaaagggataagactcaccatcccctcttcctgttgaccccaacaaagtgccagaacccctctccatggggacagaggtagcccagaacatccagaacagagacatgtgggttctaagccatcactggctgtgtgaccttgggcttgtcttatagcctctctgggcttcagtttcttcacttgtgaaatatggtagatgcttcctaaggcccttctgtctctgacactgcagcccttagaagtggtttctgaaggttgactgggtttaggggaaggttgtggcctgcgtggagctgccagatctggcggcctgaatatgtgtctctcctgcccccacacagagctccaaggcaactgctctcgcctgggctgccagcaccattgtgtccccacactcgatgggcccacctgctactgcaacagcagctttcagcttcaggcagatggcaagacctgcaaaggtatgtgagtgcatgtgcctgtgtgcatgtgtgtgtgccagtagccagttgaggtgggcagggaggggcagagaggggtagggggcctggctggaataagaaactagaaggaaggtgcaagagagggggtgccaccaccccagggcatgactgtgagccctaaccatttgcttccactagacttctaaaaattcaccttaaaattatagtttatatgtaaatttttctgttgtaaaaaattagagcattaacagataaaaccaaagtcccctttgacaaatccccctcaattccggtccccttcccatctccctggagttcaactctattatcagtttgctctctctctttcaggcccttttttgtgcatttgtctctgggtattcacagaaaatctaattggaagtactgctcaagagtactgcgtgctcttttttacataaacaatagtatactgtgtatattattttcaatgtttttcactcatcagtatgttccacaatttttttttctgtgttaatatgtaaagatctacatcattcttttagaaaccactatgacgtatgacttttaccacagtttacttggtcacctccctgttgatgagtgagatgttcccaatttttcactgctacaagcaatgcaaacttttctgttttaaatttgcctccctcgggtctttgtgcaaatgccaccttctcagtgaagccgtcccccgacccctctaaaactgcatccctgccatctgcattctctatccctgttctcttttcattgcactagcacctctaatgtatactttatttactttgtttcatatgttattatagtaactatatttcatttattatctgaatataagtttcatgaggacagcaatgtgggtctattttaaagttcactgatgcacccctggcacctgacccatagtagggactcaataaatcttccctgcgtggatgagtgatatgtacacgagtgtttctctagagtggattccaagactggacttgctgggtgttaaggtttgcacatttcatgctgtaatagattctgccgaactgtccttcaaggtagctgtaaggatggacatgttgatcatgtctgatgatcacccacttcgttgcccttgtcacactggaaatgaccacattcttgccctttcctcggcagattttgatgagtgctcagtgtacggcacctgcagccagctatgcaccaacacagacggctccttcatatgtggctgtgttgaaggatacctcctgcagccggataaccgctcctgcaaggccaagaacggtgggtggggttgcctctggccacagtgctaactaagccccctcaatgctgttccctggtgggtggtggcctgagaggtggtcctagagccctggctgcacggactcttctcttccccattcccagagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgtgagtcacctgctctcagcttggagggctggggagggtaggggagacagggaaggtggaccctatcttgaacagaggccgggagttacacaggatggtcctgtctggggcaggagaagcaggaggctggatacaatggtgtgtgtttgaggcaggggcagagccaccggcacgctccctcccagctctctgagcaagtgtctggatggcccctgcatttctggccaagggctgagggggcagtgaatggtcaatctccagagaccagggactgtcccttctctgagaggggagtgttgactagactgcagagggactttccggtgcagtgggagccaaggctagggaaagaaggagcggaagcctgaggtgccctgttaggctgcagctgagggtaaaggagctggggcccagctgctctgtctccatgggccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttcttgtgatgaaaagaaagatcccaggaggttacaagggattcattctgggagagagaaaggcccctccccgggatggtggcgagcaggggttcctctgagagccctcactctccgtggcctcagcgtaaggttcacatttctgcctttggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtacccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggacgaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgggccatgtgagtcagacctgttgtggagtcctgagagcccccgagggcccccctgaggccctgcagtgtgtgaacattcctcttcaatgccccagggctgctgaccctcctgcctcaggcccagtgttatccccctggattgggtgggtcatctcttttcctcccacctgagattacctccccctcccctctgccgctggcccagtggtttggggaggtctatgaggctcgaattccaagaccagagaactccatggtgagagccggaagagaaggcaagacccttggccagtaccaagagcagccctggctttcactactgctttctcaaaggggctatgcattgatttgattttagatggtacctggacaagctttttttttttttttttaactgttatagttacgtttttatttgatatgcattaggaaactcctgtaactagcacatcaaatctgttacttcagcaattgtttagcatgcagcgaaataagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaatacatgtgtgtcagacgcctgagacaaagacaaaaggcagcgctctccttacagtatttgcagtcaggtgaagaggccatgatcaaagaagctccagaggcctatggagcctgtaacaggaaaacttccttcttttttttttttttttttttgagatggagtctcactctgtcgcccaggctggagtgcagtgatgcaatcttggctcactgcaagctctgcctcccgggttcacgccattcttctgcctcaggctcccgagtagctaggactacaggtgcccgccaccacgcctggctaattttttgtgtttttagtagagacagagttttaccatgttagccaggatggtctcgatctcctggcctcatgatccacctgcttcagcctcccagagtgctgggattacaggcgtgagccactgagcctggccttgaaaacttccttctaatagggcaagcttccttctgggagcctgagccgagtcttgacgagtagtaggtgttagccccaaatggcccacctggagggcccacctagagtcaggaggccacagggctctggctggaggcacagagggcgacttggtggaaaaggtgggaaaggatgggttcagggaggggaggacatggtgggaaccgcagcccccatgtggggagtgtttatcatgcaccaggcctcatgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagaggtggggaggttcctggaacaagggccagaatctagtgtgctccctggggatgtggatagaggtccagggacctctttggatgtgtatacactcttgggtgtgtagatgtgttgggtgacattttctcaggacataaaggcttcttccttccttccgatttccttattttagagcaggtgactagaatcctgcagctgaagctagagtctttttgggcatggggtgggtcccatgtgtttgggaaagcagccaccatgtatggaaatgcctcttgaacaatgggaatgatggagaagttgagaaaagctggagttgtagtgagtgcagatgctgagcagtgggatggggtgccaggacaccaggtctattctggggcctggaactgaaagtcctctgtgccataatgggcagctgtggtctctcgtctgactcctgcacctcttccctgcttcctagcctccctcttcatgctggaatcccctgcccctctgcccctagaccacccccaactccttccacaacacagcctccctctctcccctttggtttatttgagattctcctgtcctcaggattttcggcctttggccagagcctcttcagaaggtgcgctcaggtggttggcccttagaaggctgggcgacaaggggacggctcccctcagggttggtggagccagaatgctcaggatctctgggctgaagcccaggactccacctggaccccaattcataagacagagaggggtggcccagatactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccagttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcagggaagcctcaggaagtcggagagaaggccggccgtagctgcgccagctggtgctgggaaaacagctttcactgatgaagttcatacacatgccagcagcccccagacccctgccgtgcccaccaagtaaagggcacgcagccctgtttgacttccagccaccctgctggctgccaggggatgcaggcaggtccctgctttgagacttcgatttcctttggaggcagcccagcagcattcatttgaatctgttttctctgtggttacagcgtgtggggcaaagaatttggttgccttacccctgcactaggccctcttcctacagggccttggcctcctcaagctactcttccccctctctccaatcttgtgaggatgggacagtactgggggcccagaggaaagagtggctgggcttggggatgcatgaatacttacgggggtaatacctcgtctctgtggccttgttctccaggcattgggatgggatttagcagagaggacctgaagaagaaactagtttgatgaagccctcagttggctccttcccttcctgtcctgtgactctgagtcagtgtcagggcccagccaagttccttgagagcggcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgaggattctttcatggccctcctcctagactctctctcctccagccctatgacttattccccacctcttctgaccctccccaggacatgaggacattgagcaataaggacattgcaggaacaggggactggggctgagtagaggaagtttggcccatgtcactggtgcccaaccttttgcccccatggatcttccctttggcatctctgtagagttcatattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggtaagcaaaaatcttcagaataggttagtccagccagaggagacaggagtaaagcattgagttaaaaaatggtggggccaggcacggtagcccacacctgtaatcccagcactttgggaggctgaggcaggagaagtgcttgagcctcggaggtcgagaccagcctgagcaacatagggaaaccccatctctacacaaaatttgttttaattagccaggtgtggtggtatgttcctgtagtcccaactactcaggaggctgaagcaggagggccgcttaagcccaggaggtggagactgcagtgagccgtgatcgtgccattgcacttcagcctgggtgacagagtgaggtcccgtctcaaaataaataaataaaaattaaaaactacaggatgaattggggaatgcaggtcatgaagtctggaggaagctgaggggatctccaggacagagggaggaacccctgtcatctcatgctgtccattcttgcctgcccgtctcagattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgaggtgagcagggctccatggcccctccaaagctggctttaccccatgatggctctgggaccttgggatcacagcccctctctgggccctcctgtggggaccctggcttctttcatgtcatgaccgattctcctagccagccactcgggctacctgccctggcccctcagcttcccctgccagcccccatccacccactcagcctccagatcccactctgtccctcccattccccttgccagtctggagcagtagcacctggccatgggcaaccctggaactctcttccctgactactgaagcccccactccaagagtttgaaggctgggttgttggggggcagagggtttccacccctgtggcttccaaatcctaaaatgggatagcaagcacaaagaccacagcagcagggggtgtggtcagattcaggaagccttctcaaggcctggcacaggggctctgaggggtcctaacagctcttcaccctgcccccagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagagtgagtgacagggaagggggtgtgtgcccattgggaggctgcgggagggttcctcaggtgtcccccacagcccggctgcctctgtctgacatgcagggagatgaaggaagtgtcccagagtgtacctgctagtgagggcagagatgggacttgaatccatattcgaaaaaagtgcttttctcactcacccaccggactctgcagaaaactaaactgattcattcagcaagtgtctagtgagcagtgagcactcactacatgtttggcactgttctggtcatcaggattaagcagcgaacgagatagatgttgtccctggcctcatggagcttatagtctagttggggaaacaaataaatgtaactttaggtggtaataagtggttatgaagaaaataaaacagagaatagtcaggcgtggtggcttatgcctgtaatctcagcactttgggaggccgaggcaggcagatcacttgaggtgaggcgttccacaccaggctggccaacatggtgaaaccccgtctctactgaaaatacaaaaattagctgggtgtgatggtgcgtgcctataatcccagctattggggaggctgagacaggagaatcacttgaacctgggaggtggaggttgcagtgagctgagatggcgctaccacactccagcctggatgacagagcgagacttcatctcaaaaaattaaaaataaatgaataaataaagcagagaatagagttaatgaggagagcaagggcctctctgaggatgtggtgtttgagccaagctctctgtgaaatgaagagggcaaccatgtaactccctgagggaggagcatgtccggcagaggaaatcaacagtgcaaaggccctgaggccagtgtgagtgtggcaagccagaggaacagcacgaaggccagcggggctgagtggtgtgagggcagagaaggaggcaggggttggattttattatatctgggataggaagctcatagtgacttttgagaatggaagtgacatgattggattcacatttgtataaaagtcacgctgctactgggtgggggatgggcagtagggaagtagccagaagactttcagtgtagtgggcaagaagtgatgtggtttacactaggatggcagcagaggaagtggtaaacagtgatgtgactccaacatattttgaaggtactccttttataccactgatttcatgactgatcagtgggcacttagctgaaaacctgctattcttccctcatttcctacccttggagtgcagaggtcagaccccagggtattgcggccaggacccatcgtcctgtatgttagcgtgtgcgtggtctgtccatctgacccagagcctcgcatccctaacgtctcctgacccatcacagctagggcattgcagccccttggccgcagcccctgggtggggatgatggtcatgtgtgtgtctgactgtaccctggcttgtgcctgctctagagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggtatgggctcctagggatgtggcccatggggatggaagggggctggggcccaggcatctgtttctcggtgccctctcagcaggatggtcccctgctgactggctggctgcactggttggcatggagatgaggggatagacagattgacccctgtgtgacccccttcttggctgagccaaagaggcagggttaggatgggttaggcagcatgggccgtccttgccagcccttgggaaaactcagggtctgtctgcattggcttagagccctggagctgcacacagcacacagccaggggacaactgaggtcttgaattggagacaggcctgccagatcaaaacagggcacacccacatgtatgtgcgcacacagggtctgtgcagctgaccttgcagtcgccaaaaactgcatgctaatgtgtcctgagaaaattgtgttttgtgagttgcatccaggtcttccctctgagctgcttgggcaggttcacagtgcattgtctttttaatgtctatgtgaaggattctgagctgtacgagttctgccccaaatctgcacttgggcctcaggatcaggccgcctccccatcaatctggtggatgccagttataacctttgccctgcaccccatccacactgtagttcagagaaaatcaacagtcagcaatcatatcacaagactttggggaaatcaaaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgcctgctgtctgtttctcaaacaagcaccccggctcctcctgcctcagggcttttgctcttggagttcctcagcctggaactcccagatatttgccggactggcttcttctctacatcaagtctcactcatgccacctcctcatggtggccttctccatcactcccctgacacccccacctgcagcccggtcactctccaccccatcaccctgctttatttccctcctggcctttatcgctctccatgtaaccttgattgacctgtttcttgtgggatgggagctccgtgggagcagggaccttggctgccttggtctccactgcatccatgaatgccaaaactgtgcccaacttacaggcactcaacaaatatttgttgaatggagtgaatgaatgaaatgtgtggtccagtgatgagcaggacaggagacccctgtgaggagctctgggacagcactcatggattgggatcacaggggaggctgttgatggcgggggtgcccaggtgatgctgaccagtcgctgcccacaggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaaggtgggcaggcatgtgcctgtgtgggggaatctgtgtgtgttgctagaccatgcttgggcgtggatgaggttctgtgtgagtatgtgggtatctgtgtgtgtccaggcctgtgtgcctctatagatgtgtgcatctatttttctgtgcatctatagatgtgtacatctgtgagcttgcatgtcttatgtattgtgttgtttgtttgaggattgcctccatttgcgtctctttgtgtctattcgtgttgtctgtgaagttgactgtccatgtgccagtctctgcatacacaccatgtgcgcctcctcatgtgtgtgcatagatacacggcatgccttggtgtgtgtctgcactctctgcaagtgtgagggcctagggacggcatatctctacacttggtcatttgggttgtcatgtgcttcacgagtcatgtacgtgttctagtatataaggcccttcatgatatggcccctgaccccctctctggtctcttttctccccacttccttcatcccaacactctttgaacaagcagcactagacagcttgctcctcccagcacacgtcacagagcatctgccctctgtgccattactcatgcagttcattccacatggaatgttcaccccagctcctcttcccctggcagactgctcaggggctacctcccctaggatgtcatctccagacccctcttcacactggatcacccgtatgtgccctatctgagacagtgggaagctcaagggcagagatcgtgtcgttttcacctcttactacctactacagctcagcccctaacagatcctggtaaatgttgaagaaatgaatggatgaatactgcccgtctgctcattagtgtgtgtgtgtgcgcgcacgcatatgagtgtgtgtgtgtgtgtgtgcacgtatgtgtgcgtgtgtgtgtttggggactatgaatgaataggaatgagcccaggagaggaccatatggacaacctcaccatcagcatccttgctggatcactcgatcacccgctggcttcaggatctaccatcccactgtgtgcaaaactatcactctctggggctcccaggctaatgggggaaacaaagcaaaacccatgcccaggacatagacaaatgaatgtacaaaacagtgatctcacaggcctccctcaattttcttccaactccttagtaacatcctctccatccctagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaaggtacctccttggggctgggggcagcgtgggacctggaaggggtggtgggacttaggcattgatttgagacttccctgggagtgaaggcacttcccagggatcctaggctctgacttttgaggatcctgagaagagaactcccccaacacaatctgattctctgttccccatttcccttcctgccccatgtctgtgtctcctgttcttcaacatgatcttcttcctctccatatttcctctttctgtccccacatcttaatgtgtctcctcccctatcccttctctgacctctcctcacctcttcctccctttgcctttccccatggcccttccccacagttggcaccaacaaatgccgggtgaacaatggcggctgcagcagcctgtgcttggccacccctgggagccgccagtgcgcctgtgctgaggaccaggtgttggacgcagacggcgtcacttgcttgggtatgaggtgcctggctgggtgggagtgggaagcagaccccatcaggaggatgccgaagagtggggaggggaggatccagggtcccagtcagagattaaggaggcaatgaggggcccttagggggccaacaggaagcaagggagggggagagcaaaggctctgggggctaggagggagtttagggaagatgggaggctgggagggacttgtgaggggatggcaattaggggaaactgagtgaagaatggacagctatggatggaaggaggaaattatccttcacttcttttaaatgtatttctccattactaaagtaaaataataaatagttccaaatattggaaattactttgggaggccaaggcaggctgatcacttgaggtcaagagtttaagaccagcctggtcaacaaggcaaaaccccatctctactaaaaatacaaaaattagccaagcgtggtggcaggtgcctgtaatcctagctactcgggaggctgaggcaggagaatcacttgaagcccggaggcaaaggttgcagtgggccgaaatcatgccactgcactccagcctaggcgacagatggagactctgtctcaaaaaaaaaaaaaattaacattaaaaaatacatataatatatatgttggaaattagagaggagaaaaaagcccaaatcccaccagtgagcaccatatattgttagcattgtggtaaagtgaacaccattcttttttcctcaggggggttataattgttttttacatagctgtaatcatctgtttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaattttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcgggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaaggcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagccaccagggctagtatgtgtgtaaatgtgcgggcaggtgactgccgtgtgtggtgtctcagggctctgttctgtctgtgttgtgttgtgacgtgctgccccagtggttcctgtcccagctgatgtgtgagcggatgtgttgggtcagtgccacgttgcccctcactttttctgtgtctcgcatgccaatggttgccccggcggtttctgtgtttcagagaaggattgtggggacggctctgacgaacagacctgtcctgagcctgccggtcagtgcatagaagcacatgcaccatcacccagagctcagctggccccagccccctgcaggttctccaggcccctactccagagctgctaggatatgaagaaaaagcaacagagaggagggagagcagaaaacagagggagaaagcaaatagtggtcaggaaagaagcagagacggcagagggagcctctgaggaaaggagatgacagagaggtggtgacaaaaagcccaagatgcaaggggaggagagagttagagaagcaaatccagttggaaaagaggcaggaacataacccaaaccccagtctccaccacatgtcccataaatacagagggtcaagtcaagcagcccccacccaatgctgagaaagcaggagcttccttcagccagcctcagcgagcttggtccagaagtggcccccactcttgccagccacaggcagggcccctgtaagccaggcacccagagcatggtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggcagggatgaatgagcctgaagagacagaggagagagggcctggctccacaaggctcccagtgccctggcctctggggcccagcctcgggggcggtggggacctagttttctggagggatgggccctctcaaggaatgctggcttcctagctctggaagatgtgcagatttttatgtgaaaactaccaaatttttaacactacagtattagtttctctcgtctcacagttctggaggctggaagtcccagacccaactgttggcagggtgggttccttctgaggccgtgtgggagattctgtcccaggcctctccccagcctccgcggtttgctggcaatctttgcagctccttggcttgtcgaagcttgacccgatctctgccttcatcttcacacggtgtcctccctgtgggcatgtctgtcaccagatccccatttcccctttctgtgaggacacctgtcatattggattaggatacacccttatgacctcatcttaagttgaccatctgcaaagacactatttccaaataaagtcatattcacaggtattatgggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcttgaaaaaagaaaagaaaaaaaaaaaaggctgggtgtgttgactcacacctgtaatcctatcactttgggaggcaaggcaggaggatcacttgtttccaggagtttaagaccagcctgggcaacatagtgagacccctttctctacaaaaaataaacaaaattagctgggcatggaggcacatgcctgtagtcccagctactcagaaggctgaggtgagaggttgagcccaggaggttgaggctgcagtgagctgtgagctcgccactgcactccagcctgggtgacagaataagaccttgtctcaaaagaaaaaaaaagtttaaaaaaaactacagaccaaactcttcctgcaggcctcatctgacccatggaccactagattacagcctctgccttatagagttagggcacattcccaccctagtaggagaagactggacagcgttgagtgcccaccttgagccctgccctgagagggaggacagagaaggccacaggaagcttgggaaatagtaattgcgtctccagggctatctctgtgaaggggagggtgaggggcacaggtgatatcccttagggttctgagaaggggcctctggaggctgtgtggtgtggtgagaagagctccctgccgctcccagataagctgggcaaatttggacaagttgcttcccctgagcctgggcatcctcctttatgaaatgagctgaggtatgtgaggcctggcgtggaggagcagggtgtcactattggtagcagttgttaactatggtatgagctggatggtctgggaccattcaggaggagttgtgtttagactgcaggtaaatggacaggagggagggtcttccagtggggatggcatggtccggagaatgctgtcgtcaagacttagagggtgaaactgagcacttccgtagggtgacagtggggccaggtggagccgttcagaccgagggaaaggctcgtgcagggacagtggggaatgaggctgtcctcaaagggggcagatgatgacagcaggtgtaaatcgtgagaggcttgatttgggaggcactgggaacctttgaaggatttccaagccggaaggtgctgtgatgtaggaggtgatttcggaacacagccctagaggaagattagattgagaagaggttcaggggccccaagaaaggaaaatcagttcagagactgctgctgaaagtcccggcatgagatgagagcatcagctgggtccagggtagggaagggggaggagcggggtgtctgtggcagcatgagtgtatgagtgtggggctccaccaggcagtgctcctgctcctctcctggcctcctgagtcagatctcaggacagcagccagagtgatcctgacaacataagtcagatcatgccctggccctgccctccagcctgtactggctccctgcacccttggaacaaatgccaagcccctctgcacggcctgcagggcccccacccctacccctctgacctgcattcctgccctcccctccccctgcactctactccagctgtggcgttttcttttttctttttttttttttttgagatggagtctccctctgtcgctcaggctggagtacagtggcgtgatctcggctcactgcaagctctgcctcccgggcagctgtggcgttttcttttctttcttttttttttgagatggagtctctctgtcgcccaggctggagtgcagtggcgcaatctcagctcactgcaagctccgcctcccagttcacgccattctcctgcctcagcctcccaagtagctgggactacaggtgcctgccaccacgcctggctaattttttgtatttttagtagagacagggtttcaccatgttagccaggatggtctcgatctcccgacctcgtgatccgcccgccttggcatcccaaagtgctgggattacaggcgtgagccaccgcgcctggcctgtgtgctgttttctgaagtgctggcgtagtcctatctcggagatgagactttgcagcggctgttccccttgcctggagtgtgcctccagggatcctctgggctcactcgctcttcatgcaggcctctgctcagattccttctgcccagaggtcttccctgaccatcttacctgacagatcacccccatccctctcagcttctacccagctttatctccatagctttatcaatacctgaaattacagtctagatttatgggttatgtcttgtctctcttccccattagaacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtgagtgagaaggcatgggggcaggcgcggtggctcacacctgtcattccagcactttgggaggctgaggcgggcagatcacttgagctcaggaatttgagatcagcctggccaacatggtgaaaccctgtctctgctaaaaatacaaaaattagccggacatgtctgcagtcccagctacttgggaggcagaggcaggagactcgcttgaacctgggaggcggaggttgcagtgagccaacatcctgccactgcactccagcctgggcgacagagcaagaccccatcccaaacaaacaaacaggcaaggggaggagggtgcccattcaagaccaaaagagatgaggttgggggagtccaggagtcagggaggaccatgtggtgtgacttggggatgaggagcagagcagccttatctggtcctcttagccaggcagagcccccagttccttggaagggaggagtggaagataaggccacagggactggctgggagaactgccgacaggctatcagtcaggctggcagtttccagggtgtgccagaggaccaagggtggtataggccctgctgcaccccaccccaaacccctccaaatcaggagagatcagcacaaggggactggacctaaggacctcccagggtccctcccagggaggcaaaaagctggggcccccgccctgggcccaagaaggcaggaacatatcgagaccagacagagatattgaggggtgctccctgtgggaaggggaggtatggtgccagctggtgggtgcaagggtcccaactctggtcctgagggagcccaggaagtcctgggctgaagctcagcctgaagctcagcaggaatggagacgaatggggccgtgggcagggcacaaggacttggtccaggctgcccaggacttggggcccagcagggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggaggtgaccaccgattgctgccaggcaggatgcacacaggcggagcgctcaggcgctaggggccacaggtcccatccaagtggccccaaagcagaggcttggctcccccatcccccacacttctgttcattgggttagattttgctgtgggtctccatgcctgacgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctgctttctgtcccaggcagcgtggtgcaccccagacttccttcagtcacacacaatagtgagtgcccactgtacacactgggcagtgggcatgcagcagtgatcaaaacaggctgttttcagttgtgtggtcaaggaaggtcccctgagaaggtgacatctgagcaaaggcttctaagaggcacattttactagagaagtttgtattgtttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctgtctcaaaaaaaaaaaaaaagttggggagacaataggagtcctactcttgaatatgggcacatcagaaactttggcagaagtgccagggttgagggtgggtcatcgagggctcccaggatttcacacattcatgcacagctccccaggagacgctaacctttcactgccctctcttctccagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggtgaggaccttgcccagccttctcctggccccatggcccccctgaagtcccattcagcctggccagggacaccttactcctcagtgccatctgcctcctcccaccctctacctacgatcccaccacagtcgctccctgagggccctgactttagccctcctgacccctccccactccccaggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagcaccctctgtgccctgagaaggcccaagtctgtggcaccaggacggggtggggaggaacctgtggtgatgagggtgatgagaaggaccaagggatctagaactaggaacggtggcaaaggactgggcacaggaggaggaggacggaggggcgtggggaggccagggccgaggggagggggcaggtagaggaggcggaagcagggccatcagctgtggttattcacactgtaccatcctctccactcacctgtcctctccactctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggtgagggctgctgggcgaagcagagatgacgcagagcaggccaggccagacctactgggagacaggggctggcttggggcagtctctcaccatgtggggcgggcctgatgacttagggccaatgggcccttcaggagagctgggtgtggggccttcccaagggtctcatcccctcctgctgccccaggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctgggtaggtgcgaggccgggcggccgctgggggctcaggggcaacaggggagccgtccagagctgcaggctgcagggccatggggcaagggagtaagtgggttaggctgtacccaccacccaaaggggctccttgtttccttaccacaaaggcgccttgtaggctcccagcagccctgttcacaaggccaggggcccaggaggacagaaaacctgagagctgggtagggtggtgacccccattaggtccagggtagtcagtgaccatcctgtttctgagcagcccaagcctgaccctgaggtcccaaggagggccacctaaccctttccctctgcctcccacctgcccccagaccataagggcaccaacccctgcagtgtcaacaacggtgactgctcccagctctgcctgcccacgtcagagacgacccgctcctgcatgtgcacagccggctatagcctccggagtggccagcaggcctgcgagggtcagtgcctggctttcctcccagccttgtcccagctccccaaccctgacccctcctaccctacagccccaccttcctcttcttaccttggggacaagactacattcgtcgtgtaggggacactggactatgaagtggctatgactctccagtgcctccagtaggattttggaaaaatagatgtcagcaggcagatcggggcagctgcatggaagaggcatgctctgagctgggttttctaggacaagtaggatttggatgcattgttcaaaggagagggaactatacacaaggcaaggtgtgtgcaggagccccagccaagagtggtgggcaaagtgtggggaagtcctggagataaggctgtgagctaggcggggctcctgtgttctgagccaggagtgcctggaaagtgatgtttggggaagatcaacctggccgcaatggtggtggggaagaaacagaggcggttaaaccagttaggaggccattaggagtaatcagagtgtgagatgatgggcctgggctgggctcagtaagggttgaagaaaagaaatgaaacccagacgcatttcacaagaacctgctaactgatttatgagcttgctgggggacagcatttcccaaaagtgcattcctaggagcctccctctttgatgtgggtagattttaccaaaagaaactctgagttgaacaaagtttaaaagtgttttgtgctgcagaacttctcagagccttgaatatgtttatgtgtgccaagaatttttcaagcgtttggggttttccaaaactcacttgaccattcatttttttttcactgagtctgagcaaccagggaccatgtggggattcactttgggatgtgctgtatcaaagggataaaggcaagggaggattctgaggtgcatgggtagtggtgcctcaagacatgggaaaactgggccaggcgcagtggctcaagcctgtaatcccagcactttgggaggctgaggccggccgatcacttgaggtcagaagtttgagactagcttggccaacatggcaaaactccgtctctactaaaaccacaaaaattagctgggcgtggtggtgggcacctgtaatcccagctactcagaagacctaggcaggagaatcacttgaaccgggaaggttcaagggttgcagtgggccaatattgtgccactgaactccagcctgggcgacagatcaggactccatctcaattaaaaaaaaaaaaaaaaaagagccaggtgcgtggctcatgcctgtgatcccagcactttgggaggctaaagagggcggattaccttgaggccggggttcaagaccagcctgaccaacacggagaaaccctgtctctactaaaaatacaaaattagccgggcatggtggtgcatgcctgtaatcccagctactcggaaggctgaggcaggagaatcacttgaacctgggacgcggaggttgtggtgagccgagatcgcgtcattgtactgcagcctggggaacaagagtgaaattccgtctcaaaaaaaacaaacaaagaaaaacaaaagaaaagaaaagaaaaagaaatgggataactgggaatgagactggcttcggagtgaccttagggggttgagtttttgatgttggagagagggtgtggcatagaccagacagagggaggacaaagaggaaactaggatcaggctgagcaccaaactggaagtctagattttggagtcacctagtcctgattgtctggtctgaactcccagactttccctaaggaacttgcaggggtgcagggttgggttgtgctgggtggaggccggcagagcacagggtgagaaatccgagtctctgctgccctctcatggtggctaggggtcctgcaggtggttccccagagctaccagccaggtgcgcttcctcccggcccatgctctggcctcaggctagggtgtgtgtgctgggtggaggatagggatgatggtggggggggatgatatcaaaggagaagcagagaacagttggagggtgacaggaaccaagtttaagggagtgttggcgatacccatgccttaagtttccttgtctttcaggcgtaggttcctttctcctgtactctgtgcatgagggaatcaggggaattcccctggatcccaatgacaagtcagatgccctggtcccagtgtccgggacctcgctggctgtcggcatcgacttccacgctggtgagccatttggtggcagagggagttgggcgtggcgtaggagctttaggggtggtgtggtgtgccctgagggtccagtgagaggctgcctgaattggcctgaggtggggcacttgctacagctgccaccctgactccacctccccttcaagcacctggcccctccggcactctctcacctctgtcttgagccttgtgagattttgacccctcaccttacccctgccttattgggcatccccatgtcacctcctccacctccagaaaatgacaccatctactgggtggacatgggcctgagcacgatcagccgggccaagcgggaccagacgtggcgtgaagacgtggtgaccaatggcattggccgtgtggagggcattgcagtggactggatcgcaggtgagcagtgggcaggtttgtggggcttggggtgtggcagaggactgggggacgaagtgagaggaggagttggcgggagcaggaagaggagctgtaggggtgcctgggagcttggagacaccaggtccacctgtcctcacctaacctccctgagccccaccaactccctccttaggcaacatctactggacagaccagggctttgatgtcatcgaggtcgcccggctcaatggctccttccgctacgtggtgatctcccagggtctagacaagccccgggccatcaccgtccacccggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctcctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagccctggaggtgaggtgggtgcctctggcctgtaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggtgagggcttctgtcctggcctcctcagctgatctcttccttccctcctgcctccactgatgccctgcttgtgccctgtccttccctcaggactcatgccaacggctctatcaagcgcgggagcaaagacaatgccacagactccgtgcccctgcgaaccggcatcggcgtccagcttaaagacatcaaagtcttcaaccgggaccggcagaaaggtgaggctggggctctgggctggggtggagaggtgagggggactctggcctgggagagtgctccccagggaacccagtgtgagagggctgggagacaagttagacccatggggcaacttccgatggcccgagagacccagggatggggaggaaaggctgaggtgctctgggacagatcttggcattggactctgggccctggagggtcattcaagctgggaataccgaggcagagggcagagctttcgccaaagcctggatgacaaaggcaccagtgagcctttcccaaggcaggccctgccctctgtaccctcccctcccccaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggacatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctcttgccaagcctgagccttctcatctgcgtggatgagtgtctcatctgagacaggattcctcgagctgctgcgcaggaaggcttagctcagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacatagtccagcctgcatgtctgtctaaaaatgtagcatccgaagctaaactcggtactccatgctcgtagcttgatcaggagagactggcacatcaatccccagacccctggaagggatgtcccctcacctccggctgtctgcagaccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggagagggttgagaggtgaccacaggtcatttgagtgaggacagcagaggttgggggcactgagtcagaccctggtgcccccgagccctctctgctgcacctcttgcactcccataccccacacttcgccttccagccaggagagcacctgccccaggctgtcccccacggctcctgtgcaggctgccctctgggccctcctgacaaatcgctgctcctgtctcttcacagacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaagtgagctgctgcctggggatgggggtagcagggagaggtgggactcggggtggcagaaactccccaggcagatccaagcgggggtgcaggagaggcaggccctcacttgagctccacccttccctgctgtgtgatctggggagaggtgcaaaagcttcctaagcttcaggttcctcttctgtgatacaagctggctaagattccagctgcctgcaccaaagggagcatcaggactgtgggggacgctctgcctttgtgattgattcattcatcagagcaccatgttggaggcacagggtagggcctctagctctgggatccaaagcttcaggcaaagaatgtttgtcgaacccttcgtacagaagcctaaggctgggcctaccaagccacctagctgggttgagaagtcatacttgtgggaagtaatggtaactggcacagggctgtatacgggtgaccacaggtgtcatgaaggcagtagattggcccagagcctggaactggaaaagacaaggaaggccagctcggacaggggaagtgctttgagcaaaagcctgaagaaaggcaaattcaaggcagggaggacagagggggacctctgcatgccatagagcataggcaggcctgagcccagccaggaagtgaggtcagggtgcggaggagttaggagcacaagccaggacaggtggcagaaagcacccgggggtgggtgctccccctggagggttcacccgcagtcagcctgctctgttctcccgcaggggcagccctcatcccggctgtttgggcctctagtgagccaccccctcgccttagggatccaggcccacatgttagcaacatttttttcccaattcagcagtgcttggaatgtttttcaaaagctttactaggaaactagtaaacacaacccaaagcagctgtatagatacgtgagtgtcccgaacccagattccccccaccagtcccccaatgtcagtcacctccaacctggctcaaggaccctctgtttcctcctgcctctgtcatctggcacatctgcagctgatgatgaaggtccagtccccccttccatgaccctcggctgcctcacctgtctggggatggcctcagagcctgtccctcatgagtctggagcttccctggagggtccagcaaggctgcctggccctcgtcccagaggacgtgaccccctggctgcccaccaagctcctttcttatgaggccaggggattccatcacgcattcagcgagtggcttttgagggcaaagaaggtgcagaggacccagtggggagcgcgaggggcgtcatgaagagcttcgtggctgtgtgctgaggactggccccacctggaagtcagggaacgtgtccttgaagaggcggcatgttagccagcgtctgaggatggcaggagtggctgggtgggagcatggtcccagtgcccaggagaaagagctgagctggcaggaggggccctccccctggccacaaggagcaggcactttcggggaatcagaaggagccagtgtggaccccagtggagagggcaggggcaagtggagactccaacaacccagcctcctcctgagccctccccgcgtcagcactggagcactgatggccctgtagagctcacagtaggatagttagaaggtccgccatgttcctggacactgagcacctaccccaggaaagcctctctctccctcctgccccattcctgggaagcaggttcacccagaccacagttgtgtcacatggaggagtttgttgacgccaggaggaaaaccacttctcactgcaggtgtgagtagtttcacctgaggtgtaggagttcctggtggggactgacaggccaagtccaatcctgacaagccaggaagatgactggccactgccccaggatacccattttcccttatggaggctagaaggacacgccgcctccctcccaacttacatcccgattccagagccaccgcaaacccctgctctcctccaggatgaggcccttaagatcagagcttctcacgagctcgccgaggctcagggcagccagtgtctccagaggggcagagcagcaccattttcctacgtgagcccagcagaaggcgggatagttcaatggtgctggagacgctgggggtgggcaagaagggtgtgacctggagaggtctgaggagacaagttcacaggccagaggacagatctgtggccagaatggtgaggggcagaggtaggaggaggccagaggcactggggtgggggcgggggcaggtcctgttagggaactggagaacggagctggcttttgtgtggcttggtggtctcagactccactgtgcctaaggatcgcctaggagcaagagaatgtggagtcccctgccccgccctgggcctagctgagtgacaagctctgggaccgaggacccagggctcaccatccaatgccggtggtccaaggaccactctgtcacacccagggtagtgcatgaccagccctgaggccttccacagcccccctccagcctcagcaccaccccacaaggagcacggcataattgggggctggctgttcccattgcctcctttactgagaggaaaccagggctcagaggggcgacaggctcattcaaagttggagccgttacgaggcagaacggtggctccaaccccaaacatgcaaaggcctcaaagtacggagaaggggactcttgagagctgcttgaggataggacccacataccccaggacctgggacacatgccacactcagctccacaagggcttcctgaatgatctggaagacagccagcctccctgcacagaagagagcagttaagaataaactcctgggaaatactcacatagtgtgtgccatctgtccttaagatggagattaacttcttccactctcacatcctgcgaggcaggtggtgctaccatccccacctcatagaggaggaaactgaggcacagggcagttgagtaagttgcctaagggcacctagctggtgggtggtggagccagggctggaaccccagggcctgtctcacttggctgcaccggctctcttctcagcaagtagacggtcactgcccagatactgcaatgtgaatatctcacacttggccctcatcccctcacactcagccacctcgtgtgtgaactgtctgtgcaatagtggggcccttcctgggcattggggcactgctggcctctatggctctggggtggctttgccctggcaggcttccaggttccaggtgcctacgcgtcctggcctgtgccctctgttgtggattctcaggctttgcctcctgatctctggaccctcttcccccagcctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgagtctgcggggtgggtgagctggcgggcggctgaggggaggccagggccagggtcagccgtcaaccaagaccgtccaggcacagacatggtgggaacagctgggaggaggtgagtgcctccaggccccagcctcggtcaaccccaccctgtccagcttgctcctcatcagctagacgagggagatagcaggatgcctctgcgggccctcattctgtagctgtcagaggccaggccaggctgtggtccggtggagactgggcaagaggcctgagcgatgctgtgacggtgatggtgctgtctccacaggtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgagtggggctgccgccagctgcctcaccctcctgcctgtcgtgcatggacatacaaacacacaccccacacacacatcgcacataccacacgcaccctacacataccacacacacacatcccacacatactacactacacacaccacaccacatacacacaccacacccctcccacacactcaacacatacacaccacaccatacacaccccccacacaccacatacacatacacccccaacacatacacacacatacacaccccacatacacacaccacacatatcacatgcacaccccacatataccacaccacacacataccacacacacaccacacaccacatacacaccacacataccacacacaccccacacataccacatacacacaccaccacacacactacacataccacacacacaccacatacacacaccacatacacacaccacacatgacacatacacaccacacataggacacacatacacatgccacacacctaccacccacaacacacatcacacacacaccacacagcacacacacacaccacacaccacacgtaccacaaacatgccacacacacacacacacatctcacagacatactataaacaccccacaccccacacaccacaccccacacacacttgcctggtcctgctctccctgggcctccattacacagacacacacagctgtacacacctttggaaccgcaaaacccccagtgctcctgtaccccttcccaccaaggcatctacgcacacagatggactctgcacacgcctggcatctcctccacgttgcacacacacattcatgtcacacccgcccctcagggctcatccatgccctcggtgcccctaccctcaccctggtcactctcctcacttggagccacacagacagccgagagcctgggtgcacgtgccctcagtgggcacgagtacatgccccagcgccccccaccacagacctgcagctttcccaggtgtctcccatgcgccctggggctcactactgcacccgtgatctcagggccctcagactcgaatctctcagaaacactcctcaaagcccacggtgccctgcctaaaagcacacacatcctcaacggcacacctgccgaaaaccccatgcacctggccctcccacagcagccatccccatgccctccccactggctgcaagccgctgtgcctgccgtgactgagcagaggcttgggagctccatgaagtcagtgaatgggtgggtgcactctgggtgcatgcacagcagagaacactctccagccctgcgcccaccctgtccctgctcaggtgaactctctccatgccgaatcaacaacggtggctgccaggacctgtgtctgctcactcaccagggccatgtcaactgctcatgccgagggggccgaatcctccaggatgacctcacctgccgaggtgagagaggcgggggggaggggctggcggggaacccaagcacacaccagggatggtgaccatctcccctacatgctccagcccagccccccaaagccttttgccaagaagacgctgatgatgacctcagctccccgggggaggaggcgtgggcactggggcccacagcgctggctcagaaagctccctccacctccctccccagcggtgaattcctcttgccgagcacaagatgagtttgagtgtgccaatggcgagtgcatcaacttcagcctgacctgcgacggcgtcccccactgcaaggacaagtccgatgagaagccatcctactgcagtaaggagccccctgcagcccctgcctcttccaggcccagagcccaggtcctcctcccccaggcccctgcaggatggagcaggatcaggacccagcttcctgaccatgagttttgggagctcatgaagggcagaaccactgttagcctggactgggcctttgggtttgggggtggccagctggacacgtgcatgacgtctcagggaggcagccctttccctgtgcctgtggctgacacgcagcctactcctccatttgcagactcccgccgctgcaagaagactttccggcagtgcagcaatgggcgctgtgtgtccaacatgctgtggtgcaacggggccgacgactgtggggatggctctgacgagatcccttgcaacagtgagtgaggcgcactggcataacccatctgtacctcagttcctgccccacccctccctggccaagctttgtccctgggccccgtggtgtctggttcaaggcactctgtgacaggccagggcaggtgctgtgggccaggagctctgtcctgcgtccttctggcccccacagagaaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagatgaactgcagtgagtgacgccctttgctggcacctcctgggctcctccccatcgctcactgcatctcccgccttcaggccctcctgcacctgcccacattcctctctgccttccctcatccccgctgacagcctccatctccctgaggccctgtccccatcccgctcctgctcctgggctctcgtggggttccgagagggggcagtgagcagatggtgcagacagtgccccaccagaagggcaccgttcaacttttggaaacacatgaaggctccatagggctggcagctgccccagtcgggggtgatccagggggaaccaggtatcaccctcacccctgcccccaccaggtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgggcgggggcaggtgtgtggtgggtggtggcctgcggtgagcagggccctcacacctgcctcgccccccaggtgtgaaacgccccagatgccctctgaattacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaaggtgggccccagacctggctcccctctgccccctccccagactgcctgagaccccgctgacctgccgcctccgcccctccgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagacagtggggatacagcagtgaatgagacagaaatctgcttggttggggtctgcctctatctggcaggtagagagccagcagatttgctgacagatgagatatgcagtgtgagaggaagagaggagtgaggcatcaagtaggcaagagatacacaggtctggagttcaaggagaggcccaggctggagagggaagtctgggagttatcaccatagagatgctatttgaatctgtgagcctggatatgattcccaagggagcagtgtaggtggagaagagaggagtccaaagtctgagccccgagctgagcaacagccaggagcagggaagtgaggggaccagcagaagagcctgagaaggagcagctgctgaggcaggagaacagccacgagaagaaagcatttccatggggagggcacacgcagctctgtcaaatgacactcgggggcacacagaaggaggcctgcactgtgggccagctgggtgggctcagtacccatatgctgctgcccctagtgaggccgggtagagggaattggagtctctgagccaggtctccagggtgggaggcccagaccctgccacatgcccagcccaaggctccctgtgcctgcagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtatgtggctgaggagggttgggggagcccctgaaagcagcatccaagcccagcctccctgcaggccactggtgcgatgggttacgggatctcccagggctcactgcctacccatcgccaggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttggtcagtgtgccagtgaggctgtccaggcacagcagactcagtggggatggaggtctgaagcgacaggggatcaagttttgggggcaagagtggacataaaaagcggaggatatggcctgaggacaccactcactggggtgtggggttcagagcaccccgggggcttccccagcctggccaccacccagctcccttgggaaggaagaggagaggcccttcccttgtatacacagttctggaggactggccccaaggagggtgggggtgggaggcctgcgattgagaactgcagtgctccccacttcccgaggggagccatacactggcagggcaggaacttgccatgaggcagtctaggtttgaactccagctctgacacttgttagctgtgagaccatggggggtctgtaccatgaaccatctgtaactggggctgacacccacctctcagggtggtggtagggcttgaggaggtggagtgggccggcaccctgtccgagctccggctgactggcactgtgcctgccccttggccctgcagtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattga

SEQ ID NO: 1135 - DNA, 254154 bp, Homo sapiens
agaactggctgcacctgctgttcttttgcttctgccttaacccttggttaccctaattcccaattctcctgcctcacaatgactcacacgtttgacagttaccctttctctttcaaggaggcatgagaaaacctctaattagatccatggaggctgtggtcacaaagaaagcccccaattcacacacaacccgtgattctcagccttcctgcccatcttcacccttccctcagcttgggggatatctaggatctcttgagaatctataaactaagaagacaaaggggaagaagttgaggaaatcaagaacaagttgggaccactaagcctacctttttgaccccatctgtggtgggggctgggagttgtggagttctggctcccaggtgatcaggccttgtggtaaggacaaggtctctgattgtagggagcctggcgtggagtcctagtctcatgacttaacctgctatattcttggggtatgttatttaatctcttggcacctaagttattttactgaataaaatggagatatgatagtactagctctcaagcttagtatgagaactaaaggaaataatgcattcaaatgcaagccccacgagattagggatgtttatttcatttgcactataacccctgatgcccacaccagtattcttggtgctcaaatatttgttgagtgaatgatgtaggtaaaccacttaacgtagggctggaacacaacccatgctcacagcaacatagtggatgttttgccagagatgcttactgcactctgcttctaacctaatccgacgtccgccaacagtccttgtatttggctctgtcatgcagagttgtgcaggggaactgtgggatcatggtggcagctagatacttaaggttggtgcttggagcctgctgaggagtgggcccagcctgggtggggtgccaagctgatgaatttcacacagcaggggtcctggaatgtttgaagagaggctgctgggtgctggcaaaggggtccattggggagctggcaggaagccaaagatccaacatgcttggtttgtttcaggaactttcccaggactggcccaagacccaggaaaggaggacgttttctttttcttttttctgtattctcttccttcctgactgtgtgactttctgttgccaaaccacagaaccaagcctcaagcaatgaattctacagctgggctacattttggattggatgtgctcttgttagctggagagagatctgaactataagttgacacattgtttctatgagaaattcattctcaattccaaacagatgattaatggccaaggtctcagaatgaaatccattctgtcccatgtcctggaatccagacaaatcagggtttgtcttggtgtatgtgtgggaggggcactagggagttctgtttgcataataaagacctcataggacccccagagaggagtcaaggtagactatgagacaaacagccccagtgcagaaaattcttaaacagattggaaggccaaggatactttagctccacaacactgcaaaaagtgttccagcaggggaaaagctctactaaagagtgtgtgtgtatgcactggcttgtctgaagacactctattgagagtagccctctaagtattgttcaaattccctctcaggaagatcttaagcaatccagtggcaccgtcccagggaaggaaggatacaaaaccagcagaaaaggctgaggaaagatgtgtagcactagttaaacccagagagggaagtcccctttcagtcatctcgtcaaagatttatcatgctggtggaagagttctctcacctcaccaagaggagcgacttcgacatgtcagtattggggatggggagaagactgaccattcagcagccaaggactgacctgctcacccaaggggaggagcccacaagtagtgagccaggactatgggtgcccacagactcatcactgccaggaggacacagaacacccaccccacccagtgccacctgaatgtaaccctcttagcttgtattatttgggagaactggagctattcttataaaaacactcctagagaggggcttcaagatggctggctagaagaatttcatacccacctcctgcacttagaagaaccaaaatagggctgggtgcagtggcggctcacacctgtaatcccagcactttgggaggccgaggcgagtggatcatgaggtcaggagatcgagaccatcctggctaacatggtgaaaccccctctttactaaaaacacaaaaaattagccgggtgtggtggcgggcgcctgtagtcccagctacttgggaggctgaggcaggagaatggtgtgaacccaggaggcggagcttgcagtgagccgagatcgcgccactgcactccagcctgggtgacagagtgagactccatctcaaaaaaaaaaaaaaaaaaaaagaagaagaagaaccaaaatagtatatagataatcacacttcaaatacattatcccagagagaatgctagaattcaacagagaaatgacaggaaacatcaaaagcaggggaaaagaagggagagaggcagcctgcctggccagggggcatgagatggatgtgcgttcccccactgccaacccagcctgtagtcactgcagatgactacaccctcttcagtggcagggccttagcatcaatactaccattcctcacctgagcactccacctaggacctgaggatcaccatggctctcacctttgggaggcctgagcacaagctcagccaatctggcttacctatctccaactccaggatacggcacacagcccagggtcctggggattgcccaacccaatccaccaccttgagaacctgaacactcctcccagggatttgaggttggacctaaactcctggcactaccacctcagctggtgctaaccagcaaagtccacatgcaggcctggagactggcctgcccagtccattggagccaccaccaacatcaatgcatactgcctgtgacccagagaatcaccttacctctgctactgctatcacctatgccatgtcagctgtccaaggtgcctgagaacccacccactcacctggtccatcgctgccactactggaatctaagcaagccatttggaagcctaagaattggcccaccagtaaccatgaacacaggcaccattgtacaccaccttggggctaaaatataggcatattcagcccacagctgccaccattggggcctgaatattggcacacacggcatgctagtcccccaacacaacttcaccacagccttcagtaataaccacaccctaactcactaaggaaagcacagatactactatgctgtttacagtcaaataaatcatacagagactacactacagcatgcactcagaatcaaagccaacgtatcctacccaagcaactccatagatgcaacttcagaaaaagtcctcccctgcaaaagtaaattcaaaaatgagaagaaacaactgttacaccaaccatcacatcagatagcaacataaggacccaggaaacatgaaaaagcaagaaaatatgacacctccagaggaacacaataattctctagcaatagattttaatcaaaaagaaatttttgaaattccagataaagaattttaaacattgatttaaagaagctcagtgagatacaagagaattctgaaaaacaatacaaaaaaaaatcagaaaagaattcaggatatgaatgagaaatttaaccaaaaaatacattttttaaaataaccaaatagaaattctggaagggaaaaattcattgaaggaaatacaaaagctcgcaatacatttgaaagcttcaacagtatactagatcaggcagaagaaagaatctcattatctcagaatcccttttgaaataatccagttatgcaaaaataaagaaaaaagaattttaaaagaataaacaaaatctttgtaatatttggggcaacataaagcaatttaatatttgcattattggtatcctcaagggcaaagagacaaaggattagaaaacctatttaatgagtagatgaaaacttcccaagtctagcaagagatttagtcattcagttacagcagactcagtaatccccaaaaacacacaaggcaaaacagtcttctcaatggcacattatattcagtctgtttagagtcaaaggtaaagagtgaatactaaatacagcaagagaaaaccatctagtaatctatctagtaaccctcagcagactaacagcagatgtctcagcagaaacctaacaggccagaagagaatgggatggcatactcaaagtgctgaaagaaaaaaaacaaaaaaacaaaaacctgccagccgaggatacaatttccagcaaaattgcacttcataaatgaagaagaaataaagtctttcccacacagcaaatgctgagagaatttgtttaccactagactggactggacctataagaaatactcaagggagttctaaacctggaggtgaaaagacaatatttaccatcatgaaaacacacaaacatataaaattcactggtaaagtaatcacataaagaaggaagaaaaaggactcaatggtaccactacagaaattcaccaaactacaatgacaatcaatatgagaaaaagtaaagaacaaagaatatttacaacaaccagaaaacaactaacaatatgacaggaacgaatggagcttcacatatcaataataattttgaacataaaaaaattaaattccgaaaatataatggctgaatggatttaaaaacatgatccaactatatgttgcttataagaaactcactgtaccagtaaagacacatatagactgaaagtaaagggatggaaagacatattccatgcaaacggaaaccaaaagcaagcaggagtagttatgcttatatcagataaaatagaccttaaggcaagaacagtaaaaaacagaaacaaaaataaaaaacaaaggaggtcattatatgttgataaagggatcaatccagcaagagggcataacaattctaaacagacatgcatccaactctggagcagccagattcatgaagcaaatattactagatataaagagatagagtgcagtacaataatagtgggggatttcaacatcccactctattaaacagatcatttagacagaaagtcaacaaagaagcattaaatgtaaactggactttagaccaaatggacctaacagacatttacagaacattctatccaataattacagaatatacaatcttttcatcaatacatggaacattcttcagaatagaccatatgttactccacaaaacaagtatcaacaaattcttaaaaatcaaaattatatcaagtatcttctcagagtacactggagtaaaactagaaatcagtaccaggaggaattttggaaactatacaaatacatgggaattaaataacatgctcctgagtgaccactgggtaaataaagaaattaagaaggaaataaaaacatttcttgaaacaaatgaaaatggaaacacaacatatcaaaatctgtgggacacagcaaaagcagtgttaaaagagaagtttatagcattaaatgcctacatcaaaaaggtagaaaaattacaaactaacaacctaacaacgcacctgaaggaactagaaaaggaagaacaaaccaaaccccaaatgaacaaaagaaaagaaataataaagatcagaacagaactaaatgaaatagaggcttaaagaaatacaaatcattaacaaaatgaaagttgctcttcaaaaatataaacaaaatggataaaccactggcaagactaaccaagaaaagacccaaatacacaaaatcagaaatgaaaaagaagacattacaactgataccatagaaatacaaaagatcatcagaaactattatgaacaactatatgctgacaaactggaaaatctaggaaatagataaattcctggaaacacactacctaccaagattgtatcaggaagaaacagaaaacctgagcagatcaataaaaagtagcaagattgaatccataataaaaagtctcccaataaagaaaagtccaggactggatagattcacagctgaattctacccaacgtacaaagaagaactaataccaatccctctgaaatgattccaaaaaagagggaactctccctaattcattctataaggccagcatcaccctgatccccaaaccagacaaggacacaacaaaaaaaagaaaaccacagaccaatatccctgatgaacacagatgcagaaatcctcaataaaatactagcaaactgaatccaacagcacattaaaaagataatacaccaagatccagtgggatttacaccagggatgcaaagatggttcaacacatgcaaatcaataaacatgatacatcacattaacagaatgaataacaaaaccatatgatcatctcaatagatgcagaaaagaacgttggataaaattcaacatcccttcagaatgaaaactctcaacaaactaggaatacctcaaaataataaaaaacatatatgataaatccacagataacgttgtgctgaatggagaaaagttgaaagaattttctctaagaactggaacaagataagtatgcccacttttaaccaattcagcatagtactggaagtcttagctagagcaatcagacaagagaaagaaataaaaggcatccaaattgtaaaagaggaagtcaaattgtccctctttgatgataatatgatcttctatccagaataatctaaagactccaccaaaaaaactcctaggtttgataaatgaatttaatcaagtagcaggatacaaaattaacatacaaaaatcagtagcatttctatataccaataatgagctagccgagaaaaaaaaatcaagaaggcaatagctacaaaaaaaatacctaggaataaatttaaggaggtgaaaaatctctacaagaaaaactacaaaacactgatgaaataaattgaagaggacacaaacaaatggcgaaatactccatgcttatgggttggaagaattaatattgttaaaatgactatattgtccaaagcaatatacagaatcaacacaatccccatcaaaataccaataccattcttcacagttagaaaaaaaatttaaaaatggaaccaaaaaaaagagctcgaatagccaagacaatcctgagcaaaaagaacaaagttggaggcattacgctacctgactacaaggctatagtaatcaaaatggcatgatattggtataaaaatagacacctagaccaacagaatggaatagagaacccagaaataaagccacatatttaagagccaattgatctttgacaaagctaacaagaacctacacgggggaaaggacatcctcttcaataaatggtgctgggaaaatcggtagctgcatgcagaagaaaaaaactggacccttttcaccatctacaaaaattaactgaaaatggattaaacacttaaaagtaagacccaaaattataaaaatcctagaaaaaaacctagggaaaactctcctggactttcttataggcaaataatttatgactaagaactcaaaagcacaggaaacagaaccaaaaatagacaaatgggattatgataaactaaaaagcttctgcacagcaaaggaaacaatcaacaaaatgaagagaccacctgttaaatggaagaaaatttttgcaaactattcacttgacaggggactcatatccagaatatatacaacaaactcaaacaactcctcgggatccttggaggaatctgggaaaggtatatttatttcagcggtgcctcagttccctgtgctgtgatgtgaatatgcacttccgtcttctcaaccttttcccatttctatgtacaggagtgtttactgcccttcctatcaccttcaaatgacagtaaagcaagaccaaactttttatcatctgctcttcagcctcattatagacaagatacgtgttaatcctttcaaaggcccagacacaatcttgttcacctctgtaacctcctccactaaaaaagaaagagcagccatttctatttagaatcgtcattttcaaccaaggctcttcgttaaatgacccaaggaactttttaaaacacacaaatggctgttccattttccctttacttcataaatgataatagtcatggcttccattgattgaaggtatattttatgctgggtgttgggttacactcccacactggggtctcacaaccgagccccctattttatagaggcagcagctgaggctcagagagattaacagtgggaagatggcccataccctatgcttaacggagctggctgggaaattgtcctcttgacaaatgactgttaggggaacgctagttattagagaaacaggaatatgcacctttcctccctgctctgccttagccatggacagcattcaaggactggctatactggtggttacctgcgactctgataacttctcatttctggagagttatttgtttcctataacttaccccagaatatcatggacacacaaaaaaatgaatgcagaggcttgattttcaatcaaattgctctggattcaattccaagaaggagtggtacagaattggtgtgactaagagcactcaaagcctcaagctttttacacagcaaaatacaactgattcatgactggggcttatgaagcacacagaaaacatctgataaaatacacatttattagaactttttcagcagcattatttccagttgtttatctaatcaaagtaattacagtcagcactcaaaatatcagcaacaaatattttgagaactctggaataaaataatcagtagtatatgtttcattcattcatccatccatccatccatccattcattcattgtttaacaaatgtgcaatattagcacagagagtcaggtatgctatttgctatgggaaagtgtatattcctgccatggttcctgttgtgcagactatacccactatttaagaggagagctggaagccaggcacagtggctcacgcccgtaaccccaaccactcaggaggctgaggtgggaggatcacttgagcccaggacttcaagatcagccttggcaatatagcaagactccatctctaaaaaaaaaaaaaaaaaaaaaaccaataagaattaaagaaaagatctggactgtacagtacattctaatataaatgtacacatttagccacagggcctaataaaaagcttaataagaatggtttccctttctattcaggttcaacttaggaaataaatagtgattataatgatattttcatagaaacaaaaacccagttgaggctttacttaactggtattttttttttttgcaccttattttatgaagacacagatttggtttcagaaattcagctactgagctccaactactagggcaggtgaccaccttgaatgtcaggtgaggggagaaattgctccagggtccatcagcagaagagctcatttaattaaccacaaactcaatgcaggacactggcacttaatgatatgggatttcctcatagacatcacaaataaaaatgttgtcttggcagctagtgagagaacacacatgaaacagagagttctggttagacaatgccaacacacagaagggccaaactgaattgcttttcctaccttctgtattatctgaggagtctacagtcaagtccagatgtctatacaacacatagtggcccctatcaacatagccattaatcaaattgacatgtaatattgaacattaattaagtgctaatgtgtaaaaatggacccaagagcggggcctggattcctttcctagataattttataggaaatatgagtggtgcctcttctttagacacggctaaaggtccccagtcaattccttttcttgttggatcatttactataatgatcaccaaccaaatcagcagacatctttattagcaaattcagtaacaggataatctttccaaaatttacaaatatacaatatatttatagtattaccttcagacaacttcagtgcaaagatatacatatagtacattgtgataattatttgtaaaaatatgagacggcataagtaaaaaaagacacacaggatacctccaactataggcaaacagggaaaaatatatttttttcataaagtactgaatgttaacttttttcatctgtttgtaaaaaatatatgtgcaaaagtgtgtttctaattattccctaaatagctggtatagctatacttcagagtcttctttaacaagatttgcggtgtctttaaaagtgtcttctgttgcagaataggttggagttgggtctcttctcgaaggaggcttaggcttagcagggagcgaaggtgatggaggtggtgtcgcagcaacactttccttttgctcgttctccatctaagaatacaatgtaacaggaatcagccatttattcccccaaggtcaccatacacggtttttcataaagaagactatttgtggccactctgctcagaataatctaagtgtgtgtccaatttaaccaagcaaataatttctaagaaaaaatgtctgtgctaagaaaaattgttaaaaattacctgtgcatagattggattttcaaagttggtagtttgtttagattttcgtttgaagagattccattttgtcacctaaatgaaaaggggaaaacaaaaacctctcagtaatggaattattttgtgggtttcttttcctcctgtctcagttttaaaatttcttcttactgaagggtaaagcaatttgggacctgggaccatgtgattcagcccatatggtaaattgttcaattcctcctatggtccctgaacagtaactgaaactctgggctcttttaatcgaatggttttaaacacttctttgacttcaaatttatatattatagaatttgtgccatagtatctacaagcaaatcacctggttacctcagtacagagagaacacataaaacagacatgcacaagatgcatctggagaaaaagagatttctggggctgcctgaaaattgggtggagatggcaaagccaaactgtaactcttattccctaaagtaacattctttggtcaactcaagagtatcccttctcccttcatcattccctcctgtgtcacaataataataacaaaaacatctaacatttattgagtgcttactatgtgtcaggaactattctaagagttttacaagtttctgattttttttaacaaaccccagaggtaggtacacttattatcctatacttgctgagtcacagcaagattatacaactaacttgcaggtagaagggcaggtaatgattactcaggggacccagaggcccataaactggagaacccaaagataatcaccctggaccatggtgcgtggcccacgctttactgaaaagttgcctgtcatgctgactgccagataaaaacctggtgggagacaagggaacagacagcctactctcaacaggagctgagggagcccacaggttttatggggtgtctcttactctgtgacagcaggggaccagcctgtggaggagtggggaacacagggctacagaagtagaagaggtcttcactttaacccacattcaagtgagaacctgctttgtacatagtgcccccaaggggaacatgaagacattcaggtcagagccctgcctctgggcgcttacagttaagtggggcgggccaaagtctcttagatgtcattgcttcaaaatgaaatggctaacttgaagttaagcaattactaacaagaggaaagggacggtgactttcatttttgtctccttgggggatcctatgcatatcaatgtaacttttggaaaatgatagaactgaatctttttttttttttttttgagatgaagtctcactctgtcgcctaggctggagtgcagtgtcacagtctcggcccactacaacctctgcctcccgggttcaagcaatcctcccacctcagcctcctgaatagctgggactacaggcatatgccaccacactcagctaatttttgcatttttagtagagatggggtttcactatgttggccaggttggtcttgaactcctgatgtcatgatccacccacctcggcctcccaaagagctgggattacaggtgtgagccaccgtgcccagcccatgtttttaattgttagtctttcaacatatttatggatgaaagatacatttgtgggactctggcatattcaaatcaacctaggtgatctcacccaagcgcctctactgcttttaaagcatgctggctgttaactcagtgcccaggagggaagaaatacagtgagatccctggacataacatggaagacacattttagagggtctcagcctcactaatgtaaaaaagtaagaggaggaaccaaggtattacaaaagggaagagaaagaaaggactacaattggtgaagatctgctctcctttgaaagagactgtcagtttacattttgtttctgataacagacatgcagatcagaggttacagcctccccaccacagtccccttcctgcaccagctggggaaaatgtctatttagtgaagaagatcactagactagagatggactgagaaaaaatgttgaaaatataaaataaatctggcactagcttggggttgactcaggcttggaggaccaaatatatgacattcaagcatccgtgtgtctgtggaaaattaatcttcaaaatccatttttaatatagcttaaagaaaaaatgtttagtcccttgaaaaatctgaaactgaaaattcctttctagacaatatttatgtatgtctgtgagtgtatgagtgtgtgtgtgtgtgtgtgtgtgtgtgtgtgtgtgacatgagaagaagaaataagggaatttgagaaggtgtacagaagccttgatatagactcttctcagcatcaatttaggtcaaattttattttgatttaaatcagcagaacagaaaccaatgtttaaggtgataatgagactgccaagttaccaagatatcaatgtttatagactatgaaatttgagaaataaagattgtataaaatggtaaaatttccaactactcttagactttcatttctttacattacttcacaaaattggtcatagaatcttagaacagagacattccagatcctagcggttctcaaccaggagtgagtgcacatgtgttggggaggggaggtgatttctggggtcacactgaattaggggagacactactggaatttagtggacagggaccagaaatactgaaattccctgagtgcataggacagttttgtagcacaaagaactgtcccactcaatatgccaatagcgcccccagtgagaaatattattgaggactctagccccagaagtaaaacagtttgtccagattcaaacagctatatctggtatagctgcaaatgcattcattaaaactaatgatatacattaatacagagtttaatatcaaatatatttattgaatttcttcctgcagaccaaatagtgtaccaattgcaaaggacctgcaggcatgtttaagaagctccatctagtggcatttttttctttcaatctccagtattaaacaccatccctgacacatcgaggggaataacgttagttagatgattggttggccaataatgaatagatggatgatgaatggaaaaattagtgccatctagtggtaaagatctgtaatagcaggagagcgaagaacagcttgaaagaataaagatgcatgctgtagagaaatcacggcacacacagacggatctttcatctgtatctttgacaccgtgaaatctttattcatactgagtcaatttctcaacttaaatgtctctggtctgaagatactggatccagaagtctatttgttcttctttgtgacatgtcctcctatgttacaaggaacattattcccaactcgatgttagaatgtagctttatttggtggaaagtttttcaatctatgactttttaaaaaattatatttattaactgtcaacacatcttgagatctttgagccttccagaatctcccttgtttgcttaaggttaataaaaacccagtcatcccaaagtttttccaaatcccacattatttcaggagtcggcaactgttacctgagttccatcagcagctggtgaagttgggtttgtctctggaactatctcagaagggtttatgggacttccataattcttattatccacattttcagatacagtcacctgtggacatgttaaaggcctttacccaattttgaaagaatttagtagtaaataaatttgctgtaaagtttgtaccaactctggctctttttgccatcttgttctcccacagacatcatcaggcaccatttttattgcatgacccagtaggccaggactaaacatcactcccaccgccccaaaatcaagagcagcaaccactaagtcacctcataccttaatcctgggaggcaaatacatccctcactggtcacactctcacttattactagcaatttctactgtattctctataccttcttactcccactgttgaccaaatttttggataatcatactctagttatatactggaagccaaatcctagaagaacagcaagaataattccccaacctcactgatgaactgagaatcctatctttggatcttaataatttctttgaatattaataaatcctatcttcggaaattaagatttcatagtactactaaaaagaggttgaatttttgaaaagatgagaatgatagaattaataatcttctacgcatttttctataacattcatacaattccaaggttcccttttaagaccaaattaccatgaatgcataataaactacaaggtagacaattcactccttttcctatattttcacattcattacttgtttattctgaaacttggatatgcatttgtatacatggcctcattttattttaagtgaagatgtcaaatgaaatgtcgtatctcttttatcatgtgattaaagttttcatatctgtttatcagaggatcagggaaaatgctttcaagatttaaacatttccgatcttaaaatcacaaaatatttgtaaaataaacatttctagtttctgtattaaaatgtgccatatctcgagttcaaaaggagcattaggtgttaacaatgacagttattcattgtcactaaggccatagttgttgtgacaaaggagatacatgttcgcagttgacaagcagtaaaagtggcgctggggctattgatgcagaccttatgtaaagttattcccttcacctatattcctatttcatctcccagctcttcttaaagatgacggactgaatctcaaacatgctttctttactattcctttgcacccgtcatcccagcctctcttcactttcacttagactgaacctgacacccatcaggctcagcaaattacctgggctgtactgctgcaaagcttcacagacagcccccattacttcagtcaagcccaaatttcatcctcatctgttacctatttcggcataattctcataaaaacacacatgctctccctgctgatcaagtctgactaatctcccaaacctcaatcccttctacaaaacaacaactcctttccttcctaggcatggttagtgcagtcagaattcttacacaagagccgggaccgtgccctgtagcctttctgtccaaacaacttgaccttactgttttagcctagccctcatgtctgcgtgcagcggctgccactgctttaatacttttagaggccctaaaaatcacaaactatgctcaactcactctctacagttctcataacttccaaaatctattttctttctcccacctgacgcatatactgtctgttccccagctccttcagctgtactcactctttgttgagtctcccacaattaccattgtttctggcccagacttcaatccagcctcccacattactacggataccacacctgacccccatgactgtatctctctgatccacctgacattcaccccatttccccatatttccttttttcctgttcctcaccctgaacacacttggtttactgatagcagttccaccaggcctaatcgccactcaccagcaaaggcaggctatgctatagtatcttccacatctatcattgaggctaccgctctgccccgctccactacctctcagcaagccgaactcattgccttaagtcaaaccctcactcttgcaaagggactacatgtcagtatttatactgactctatatatgccttccatatcctgcaccaccatgcaagaggtttcctcactacacaagggtcctctatcattaatgcgtctttaataaaaacgcttctcaaagccgctttacttccagaggaagctggagtcattcactgcaagggccatcaaaaaggcatcagatcccatcgctcaggacaatgcttatgctgataaattagctaaaaaagcagctagcgttccaacttctgtccctcacagtcagtttttctccttcacattagtcactcccacctagtcccccgctgaaacttccacctatcaatctcttcccacacaaggcaaatggttcttagaccaaggaaaatatctccttccagcctcacaggcccattctattctgtcatcatttcataacctcttccatgtaggttacaagccactagccagtctcttagaacctctcatttcctttccattgtggaaatctatcctcaaggaaatcacttctcagtgttccatctgctattctactactcctcaggaatttctcaggccccctcccttccctacacctcaagctcggggtttttcccccgcccaggactggcaaattgactttactcacatgccccaagtcaggaaactaaaatacctcttggtctgggtagacactttcacaggataggaagaggcctttcccacagggtctgagaagtccactgcggtcatttcttcccttctgtcagacataattcctcggtttggccttcccacctctatacagtccgacagtggaccggcctttacttgtcaagtcacccaagcagtttctcaggctcttggtattcagtggaaccttcataccccttacggtcctcaatcttcaagaaaggtagaatggactaatggtcttttaaaaacacacctcaccaagctcagccaccaacttaaaaaggactggacaatacttttaccacttgcccttctcagaattcaggcctgtcctcagaatgctacagggtacagccatttaagctcctgtatagacgctcctttttattaagccccagtctcattccagacaccagaccaacttggactgcaccccaaaaaacttgtcatccctactatcttctgtctagtcatactcctattcaccgttctcaactactcataaatgccctgctcttgtttataccaccggtttacactgtttctccaagccgtcacagctgatatctcgtggtgctatccccaaaccgccactcttaactccctcttaaagtaaataaataatctttgctggcagggctatgccgaacctccttgggcactctctaattagatgtcctgggtcctcccaattcttagtcctttaatacctgtttttctccttctcttattccatttactttttcaattcatacaaaaccgtatccaggccatcaccaataattctacacgacaaatgtttcttctaacaaccccacaatatcaccccttaccacaaaatcttccttcagcttaatctctcccactctaggttcccacaccgcccctaatcccacttgagcagccctgagaaacactgcgcattatctctccatgccacccccccaaaaatttttttctttgccccaacacttcaatactattttatgttatttttcttattaatataagaaggcaggaatgtcaggcctctgagcccaagccaagccatcgcatcccctgtgacctgcatgtatacacccagatggcctgaagtaactgaagaatcacaaaagaagtgaaaatggcctgttcctgccttaactgatgacattccaccacaaaagaagtgaaaatggccggtccttgccttaactgatgacattaccttgtgaaattccttttcctggctcatctggctcaaaaactcccccccactgagcaccttgtgacccccactcttgcccaccagagaacaacccccctttgactgtaattttcctttacctacccaaatcttataaaacggccccacccctatctcccttcgctgactctcttttcggactcagcccgcctgcacccaggtgaaataaatagccttgttgctcacacacacaaaaaaagatgactgagcaacaaggctgcaacaaggaaatttagatatctgcccatcaactctagagacctttgtacttttcagaaaagtatggcaacagcaagcataagaggtccctctccctttaatccacctcaaaccacatgcttgggatagcagcaagaaccagagagtgggccccgtccccaaattcctgtatagtgacctgacaattctccactcattcatttcacaagtatttgtagagaagctgtggtgcttcaggcactgtgtttcccaggcccctgaagggactcagacctctcttgctctgacaccactcaaaatgaaaggttcttggccagcagccccggcatggctgccaaacctccaccactgtgcaacagaacaggattctgattgttttcaggtcttatgtccttgggttggtcctgttcctgcagatagggcagctgcagcatggaccactcactatgcttccttccctttggagggaaggttaggaaaatcctaagacatgactcaatagattaagatccagcgacagcagtaactgaaagaaaagactgtatggtttctcacctggattggctgaaccactttgacagcactgtctctggctgagtacattgggttttcaaatattatgggctgcttccccatttccatgacaaagtcttcactctgatggcagagacagaaagagagagagagagagagagagaaacagagagagagattacaccatactaatctggttcacacacaaagaaaggtgccttcctcacacctggaggtacgctaggtgctacgtcataagttacccaaaagagaacttgcaaaaaaaaaaaaaaaaaaaggccagcaaaacacaagacctccatatggcaaattattatgcaaagtaacataacatgcactaatttaccaactcaaggaaatggtaacattcttcttatatccaaattctcttaaataactcacttgggaattgggtctgggccacagagaaaaggataatggtggaagaagaaaagaagaataaggagagaggggaaggaaaaagaatggataatataatattctcagggaaggaaaacaatgaaagatttgagggagagacaaaattctgaaagtggtttcccaatactgattacagaaagccccctcagtgccaagactgtggcagccccctcataaagtatttcatttggtcctcccaggaggtattattttacctgttttacaaatagggacaatgagggtcagagatatcaagctccatgtctattgtcacatacttagtaggtggcagagccgtggtctggaccaacgccaactctaaaatcactgtttatttcatcactatacattggcagaaaaatatatgacactaggaaaaatatagttccctactccttttatacatataaaagtcatcaaataaaaacaaaatatcatgtcctcctcacacaccaccctcaaaaaaaccagaaagctcttcaatattcaagttaaacttcagactgttcatgattccaattcaacagcgtggcttagagcaggggtaaattccaatgttattaccaatgtttttagacacctttcagcaacaaacctaatgtttcctaacttgtgtagtgcagaccttattctgagaggcctaatactgtatttcagtcttctctaggtgaattttgttctttataaaaagtatttattctataaatgacaaccttcaaataatcattttgaaaccatactcaccattgccattgacctgtcaatagcagtctcaggtccaaaaccagacactccaatatccatgttaagatctgcccctgatctgaaggtcaccccattcccattttcagagggcttgacgagactgcttaagctggaaagaagtaaccaaaacagtgtcttgttatttaaaacaacaacaacaaaaacaacaaatacaacctttcacaatagtaccctctcctccacattgccaaatcttcctcaaatgtaatgctcaattcccactctaaatttacactgtcaaatatggtagtaagttcccttagctacctggaaacgttaaagcacattcctgaaccatgagatctaaaagaaaaagagtccagcacatagaaggataaagcctgggccatcacacagctgccttttcactcctctctgacctgaacacctaccagtaggcacaaccatttggactacaaaacacagcttgtcactcaggctttagagaagcacttgactaagaagttgggatttgaagtgactgctttacatcctcactactttttgtttctgtggaatcggtgaactgcgtattgtgcttttttaacttagaaagaaaactaagtccttcacatggcttcatatgaatttcttaggcttcaaacatcaacgttccccataatgaaactgaccttggcagcttgggcagagcaggcaaaagggagccggtccttctatagtggaagaatcctgcaattgccagagctccaattacgacgatcaagaggattgtcaacagcacagctactgcggctatagaagaagatagcagagagcacatcaacacatgggagcccgcaatcctggcagaaactgggggctagaaccactccttcaaagactgggttaagtagaaaagctgtgacagcattcaatgtaggggccatgagtaatttccaagttgctcacattcttaaaacttacttgttcctggagagatgccttttgaaaacgccatttcacaatattttccggtgtagccgctaggacacctgaaaggaaaaagcaaatcattcactagctgttatgttcttaggcttctactgcatttttctgagcacatcctgaagtagagagagctttgactgcataaattacatgttgaacagacaatgtatcctgcatgacttttgttcattctgccaagagaagacaagcagaaagaacagtgctctgattttagaaatgcacttgtaatggagtagctgtggcactgagggggtgagtctggccacgaaaacctattggtgtctaatctatgcaatgcttccttagagagtacaaatggaaaccatggttatgtttctttcttttatatgctttcattaaatgctttttaaagacatccatttatcttgctccatgttagagttttcgcaacacagtcatcttctttccgaatccatcccagtctttctgctcatcacgagtgccttgtactaaagcagccctgcagacagctcttctcccacagccctgttgtaatcaacaataccaggtgagtaggaaaatgctgctgccaattctctaactccttgctccccaaagtgtggtccaagaccctgtggcctacctagagcttgttagaaatgcagaatctctgtgcgtgagaatgggcacttgaaccagatctccacgggattcttatgcacattctagttaaagaagcactgcctcagttctctgtagactccctcaagggaaggcaagctggttaaaatgtaagaattagtgaactggtgaggttcctgtatttgttttcctggctactttaaggtctcaaatttccccagaagaggcaaggcctatagctgggacctcaacattcagacttacttgcatttggggaggtcagtctcatcaaaatagcaatttcctccgtgcatgcacctgcatggggggggcaggttgataggcagttcgatggctgcaggaagggaaagccatgcaggtgttagtcagctgtactcagcagagtgcccacaccatgcaaaccggcccaggttaggggtgggaggaggggcaggccagccaattagtctccctgtcaaagcttaccttccccctaagtccagtgagtttccttaaggtcttggagagtaacatacatttagtggaaagaaagggggcagtttatagaatttttcccaaaaaacaatggagaggtactagactctggagcacatatattaatagttacaagaacctagtggtaaaataatctcttaaaatattcacattctcatttgaagttttcagaattctcctccgtgaacccagttaaaatcaagagtttaatgtaggcccaccttgaaacttcaactaaagacaccaaagcatcagtaattgatcagtccacaggcagtcacatagctacagatatagagatatttgataggcagttagctagagagctcctgagttttcaagtcctcccaaactgcccttactccaagtccctgctcccagctaggcctgtacatactcccaggatgtgcctgatggggaattagtgcttcagtgtcttttatattgaagatgcttaataagtataggttacatgtgtatattatttaaagagtctagataccctcctggctcagtccttcaatctgagtctccactcaatgttcactgtatcagacaggtcttccctgaacactatctaaaggacaatccccactcaccccatcctcatccctcttcctctgccttcattttctccatagtaccacctgaactaccatgtatttattgacttctctatttattgtcctcttagaatgtaaactcaatacacacagggggttttgtctgttttgttcacctctgttacctccagcacttagaacagtgcctggcacatagctggcactcaagaaatctcactggactaattgcttaattattataccaaaccgaggccctatatggaatgactgccatcattcgtgtgcttacttcggttaaagttctttaaaacaagaatcttaataaaatccacttggcaaaaagtttaaatgagaaaagtagtagatgaggtgacaaccaggaccacactgctcccacgatgtgaaattgcagtaagtggcaaaacaatctatccacagcatggaacaaatctcaaagcctgaaattgtcattttgttccaaatatggctcgaaatattggattcctaccaatatttccccagtagcgttgggatgagtgcaagagtaggggaagaggggtgacaagaaacagttttttctccctggattcattccctaaacctgccaactcctcagcctgtttggaatgagtcaaagggtggttcctggtctaactgcctgctccccctggtggtagaaggtggttaagcgttttcctttccccatcagctaaaactgggggaaggccccaaggatgtgagccataaaatgggccgctagtgaattgcaggacgactttttcacaggcttttccagcaccggatgctagttagggacactagttattcgcccccatccggcttattaactccttaaaagagtcattgaaaaaaagtcttgccaagaatagatcacccacagcgtttgggactagaattaaaccacagcttcctcatgctggtcttcgtctcctgataatataaagcacttttcaaaaggtagccctttttcagttgtcaaaactggacatggttctctaccctgaggagctacaattaaggttgagtggattctggggcaatgggaatccagcttgaggtagaggtcttataaaaactcactcttcaaaatgtctttacaaaacaacacagcaatagatttagggacactggatctatatttctgcagatcttagcaaataattctcagcagtcactggaacacagttctgtttgccccctaagtcccactcaactctgttcatacctcccacatcccttaaccctccttccagccatccccactctgctgcaaaggacccagcatacagggattcttctgactcctgaaggcagcagaggagtgctcccaggcccccatagctgcttgggcagtgctcctacctgcatcacactcagtggtgctcccctctataaagctggagccttggggacaggcacagctgtatcctccaggtctcagaaggcagaggtggctgcagatctgtttgcaaaggttgggcactggaaagcgggtgagaacagcagttaggtcctgacagaatgaataacctgaatacccagcaactggaagtggctctgccaggtgacagcagagcctaggcatcctctcaatacctctcgtccacgtgtcagctggccactcaccctcatttacactatcatctctgccaccacactgcagtgggatagtccctctctgggccctccagccaatttctgtaccactcacattttctattggcatcacttatcttctctgctgccctgagaggtttggaaggtgggtatctggttcactgcctaacctcaaaatctactcagtgctaaacaacttgagatggttcaaaagaccagtgagatccacatattataccaagatttgtcactacccaaaactggacagatcataacatatggtctatccaaagtatactggatgtgatttccaccccaaccctccaaggagacatttcttctgggtttcagttaccttaattgcaagaaaagggaatttagagcaatggttcctcataatcacctgggagctattcaaaactattgatgccaggccaggcgcggtggctcacacctgtaatcccagcactttgggaggccgctttgggcggatcacgaggtcaggagatcgagaccatcctggctaacacagtgaaacctcgtctctactaaaaatacaaaaaaaaaattagctgggcgtggtggcgggcacctgtagtcccaggtactcaggaggctgaggcaggagaatggtgtgaacccaggaggcggagcttgcagtgagccgagattgcaccactgcactccagccagggcgacagagcaagattccgtctcaaaaacaaaaaacaaacaaacaaaaaaacctattgatgcccattcacagagattcagatttgaattggtctggggtagagttcaagtattaccattaaaagctccctaggtaagtctagagccttattaattctaccttagcatgtattatgatttatccaagggttgtactggagtggataatctttacattccttctcagactaacattctgtgatcctgattgtctgtcattcaagatgtaaccacagacaaagcatagctataaattagtaacacatcttccaaaagcctccatcaatatctgtctcattaccatttcgtcggccctccagagtggagattttcaaacttgaatgtgctatccatcacctggggaatcttgctaaaatgcagattctgattcagaaggtctggggtgggcctgagagactgcatttctagccagctcccataaggatcccaagactcctggcccatggcccacactctgagtagcaagggactggagcagcggttctcaaaatgtggtcactgaaccagcagcatcaacgtcacaggagaactagaaatgcaaattcttaggccacctcaggcatattgcatcagaagtgcaacagatggggcccacgaatctatatttaacaagctctccagataattctgaggcatgctcaactttcagaactcttggttcaaacaggctgggctggggctgtactccccatccccacccccacccccacccccactccaccagcactttccaaaggagccgccttccctgagcatcagctgccggagggagatgcttttccttcaggggcagcctccagactttcctctgccttctcctcagggtccagaggcggtagggaggggagatagcctttccaggtgtactgtgccttcctctcctacctttaaaattgccaagtgtgagagccgcaagggcacttaggacacaaaagctattctattggtagggtctggagtattctggagtgttttggtgatatacttccaaaacaaggaagccatgccctagaaaaggcatttgccacccctgtcatctcatgggagtctcagctttgagttgcaatttttcaaggctgatcaaggtctcaaaatatcagcagactcaagacaaccccagactccacccatgactcacatatggggacaggaagggagtaacttgtcaaaggccacatatccatagcattcaacctgggactttggcatactgaacactgggccaatacagcaagatgctgagttttgggttggatagaattgaacctaaaaattatttcatttctgagattaaaactcacccatttgttatgtgacttaggcacacaagttactaaatctgtctcggcctcagtttctttatttgagatgagaataaaatgtctttataaggtttgggaggtctttataaggtaattgaagtaatagatggctgaattaacactgaagagagaatttgacataagaacttagtaaaaggctatttcctttcctcacttccctttgcctttcatcttgctccacacactgctgaaggataaattagcgcacaggtaacctgaggaagcagggcccagaagtgggaaagtgagacagaggggagcgggtaggaatgcacatgactggccattttaaactaagacctacatatctcaggttgacctgactagcctagccttgcaatgggaaggataagatttctgatgcctatgaaacccattttgtgacttgttaacccaactcacatttagcaggggactgatgtctgctggattctgtggcctagaagtacatatccatcactccaaacaatgatgagggctaatatttttacttacctgctgatggtttgcataatttcatttgaccaccaattttatctttctttggtgaaaatggttaaaacgttcctctcccccagcaaacgtacatacacatatacccctttcatgcaccaagagattagcttgttgttatctactgccatcttccagcaatatagccattattttgaaataagatttccaagtaatgaggagcatcttataccaaagttggtgattacctgacttattgtatctgagttgatgaaagattcgaacttgagtgagccaagggttcactaccagcgttttctctttctttccttgcccaaatttattttgtttccatacttctcccttttccttagatatccagtataactggtcttcaaagatgtccaggctgtaagggttcattgctgcttacccacaggggaaaaacaaaacagaaggttattgaaaagaaaatacccactacaccctaccgccacttctagatctgatgtcattctgcttgaattattccctcatacaatgccttgaagctctgggaatattcaggctgactttagctacatgggactgtgaaagtgtgctgcattaggaggtcaagaagatagaaattaaaccacattgatgtataccacccgacaccaatcacagggccctagctcactttcaagttactgattttactgcatttttggaaaacaatttaaatggcaagattttatgttttcttttgaacataagacatctatctgaccaaataggaaaaatgtgatatgtgctgggtcattgcaattctgcagagtctgaacaacaacaacaaaaaatgttcatctcctagatatttacagttgtgcatactgggcaatctagtaaagtgaaaatgaatgtgtccagaagcggttagacatgaattaacattggtacacatgaaaccacctctactggggcaacctaacaggaaactcagttatttcaatatcttctgctgagaagcatttttttttaaagttgtgtaaaaaggacgaaaaggatttaattattgctaatgaactcatctgcatttaattcagcaggtgggagttggtgggggtggaggggtggtatctaaaaaactatataagccatttcctaagagcagggctccttcttgagaaaacaggcaaagacattagaaatatgttaattattaatttaatatattactttctaactaatttctaaccttcctttgcaatgactctcctatcagtcccatcatattttatggtttcaataacgtcctccttgaagtcactccagtagattcggtcattgttcaaataatcgatagaaaggccagttggccaaccaaggtcctcgaaaaccaggatgttgcggtcctctccattcatccaggcagactcgattttaggttcctttccccagtcagtccagaacataagcctataacagaagatttcttcactgtagcatctcacctggtaagacttctccactacagcagagcacagggcattacctacagggaaaccaactgtttatctcagggacctgggtgctcagtgacaccagttttatattttacagaagatggggagcaaaaataggggcgcaagagcacatatgatttatccttcttgaaaactgcacctccttaatagaaattggccgaaggatggatattcagaccctttaaaatgcattatgaaagctgtattatgaaagctgttcactcttcaagaaatattattgaaggcctactgtgtaagaggcactgttctgtgtttgggatctatcagagaacaaaacatacaaagatttctatcttcatggagctactctgttgcccaggctggaatgcagcgacataatcatagctcactacactcctgggctcaagcgatcctctcatctcagcctcctgagtagctaggactacaggcatgtgccaccatgcctggctagttttttgtgtttttagtagagacgtggtttgaccagtgctgcccaggctggtcttgaactcctggactcaagcaatccccccacttcagcctcccaaagtgttgggattacaggagtgagccaccacacccagcaactctttttaaatatgtcttttgcatccaattaataattaattgtagagcaagggtctatgtaagcaaagatgatctcacattgaattacctagaccagggattgcatgatttcaaatacctggagaggaacaggtatgtaagatgaatgaggagagatcccggttgtaaatatcaagtgatgcggagagcaagaccctgtgtaagagctcctgtcagtgcccaggaaggcagacctacccagtgtaatccgctcctctgatttccaaagcaagaaatacaggttttctttcttttcttaaattttaaatgtcagcactatgttaaaaaaaaaaaaatcttaaagctctgtgttgtcccagccaaatatgtcctatgggccatatttggcccaccagccgctgctttgcagcctgtagtctaaaccagtcatcaggcataggccaagttttaaattctactgacgaatgtgtggattttagacaaactgggctctggaaaaaatgcagccaggggcctttaaagtctcaacaactggtaaataccaccttgtttggttttcattaaaaaggacacacatgtgaaagaagctagtcacaaagaaccacatactgtaggattccatttgtaggaaatgtccagaataggcaaatctatagagacagagagcagattagcaggtactgagggcaggaaaatggtggctcagaggaacagggtttctttgtagggtgatgaaaatgctttaaaaccgattatgatgatggatacacaactctgcatataccaaaagccagtgaattgtacactttaaatgggtaagttgtatcataccatacataccatatgtgaattatataagctgttttcttaaagataataagccaggcatggtggtgtgcaagtagaaggctgaggcaggggactgcttgagcccaggagttcaaggctgcagtgagctatgatcatgccactgcactccagtctgggtgacagagcaagaccctgtctatataagtaaattaattaattcaatttaatttaaattaaaaagtattaaatactcaaaactaaaaaaaacaaaacgtagggaatggaatggaaaaaacacacaaaaggtacacagaatgatttttgtttcctccatgacttcgtttatgctattgcctgagcttctgaacagccggcctggctcctttgcctatcagtacccaagacatccatctaggttctatgtcagtcccactttctctgggaagtggcccttctcactctcacccacattgacctcacatgtcacatactttatcactggttatactaccagtggatcccaaccttcaacattcagttcagtgctactttctccatagagcttccctgaacccttgtaaggtaggagaactatcacagtgtttttcagcagtgtcctcatgacaattctccctttgtatcttatattatagtcaacagttgctgtctgaaggagcatggtgttattttacccatctatgtaaataagggatagaaacctatgactaatttatagatcctttgtacaattcaaatgagtttatatatgtaggacacttagcagagtagctggcacacagcaagaatagaataaatgttggcacttctcattgctgttgctggtattatcagtagttatcatcttcatcatcctttggacccactggcagatcttataccgcagaagctgtaagaaggttcaacacatcatatatgcttatgcttataaaacttatggatgatgagcctttcaaatggatcatgaaatgaggaggttgtaggtcgggtctgcaggccttaggcagtgaaaccctttctcactcctttcttacttcctatccctcacaggactacactgagccattccagagagaaaggaattacaaagactaaaataagaatttctggccaggtgtggtggctcacacctgtaatcccagcacactgggagggcgaggcagatggatcacctgaggtcaggagttcaagaccaggctgcccaacatggtgaaaccctgtctctactgaaaatacaaaaattagcccagtgtggtggtgggtgcctataatcccagctgccaggaggctgaggcaggagaatcacttgaatcttggagacagaggttgcagtgagccgagatcatgccactgcactccagcctgggcaacagagcaacactccatctccaaaaaaattaaaaaaaaaaaagaatttctatgaaaaaaacagtggagggatatcagagtatgataataatatcagatgaatttaaacattagttacagaggaaaaaattaaacggcacactggaaacagtcacatcattcacaccatagaacacactgcatctctttgctcctaatatattgtgtagataagatataagcagcaatgactaatgctgaggacaagtcctcactacaggttaatctcatcagtcaagtatttttcatatttcattgctgagtttctgagggtatgatttaacatatgaaatataacagaattaaagtaataacagctcatagggttctacctacaaatactggcatatctacagagggctagactggtcctgcccaagtaggaaaattatttggggtcattcaaaaaacttttttaaagtgtcactattctgaagctaagctaatatgtaaataccaagtcatttcagcttagtgattattcaaataaatgtcttgaaatgtagagaaaaataacaaaacttgttctcatttacactgagatgatttatagataaattgcaaattggaatatttatacaaatggataatatatatttatacatgtgtcattttaaatatttatatattttggatataaatgtttaatttttaaatgaaatatgaccaaatccctagctggatttcaatgaatgagttactttaaaacatccaaatgaaaggaaaaacaattctgttgaaaccttcacttaaaacagttatatccacaaagaactttagagttcagagctctgatttggcaaggaatccatgtaactagaaagattctcagatgtgttctaaaggaatttccccatcagaaatggttggttctatatgatctcaagggcatgttataattcttgaaacagtcatagacgctactcccaaaaacttgaaggacaatttcagttaaactaggaaaaaaaaattataagaaacatggaatttgatgagaatccagggagaaatatctagatgttgaagacttctccaagtacttaccctagtttgggattcacagcaatagcagctggttggtccaggtcagtggaaatcagccactttctgtaccttccatcaagtttagccacctcaatgcgtttattcttgacatctgaccagtaaatatgcctgaattcagagggacaaagttaaacaactgcaaagcctagagtaatcattactgggtaagaggtttgaagatgagagcatttcgtttggctggtgagacagctgctcagatacctatcatcagaccatagtccccctctcttgggggaactacagccaaggggacatgtttggcaggttacacttggaagagtaaggaattgaggggactcctgcccaacagccaaagcacctgaatcacgcaggatccacaatggaattaactcaattccaaagactaaacaggaaagtcaaatttccaatctgttttaactacaagcctgctaaatacacaagatgtggattgctcgtccccaagataactaccatagacacagcagtcagactggcctctgactggcattattatgagacatgggcttctaggtagaagtcataaggcacggtggggctggtgccttaactctgactgcccatgagtctgtttcctcctcaggaaagagccccgttagaatcaataggaacctggtgtcagctcaaagatgagtggaaacagccttttaaaataacaaactcggcaagactgtcctgccttatttccacttctgaggctgcaggtctcagtctcttacaagcagaaaaagttccaccactttcttaattctcttattcattaaggctgagaaagaggtaaaacttcaaacaagaagacagatctgccattccctggttggttttcagaagagagtgttaatgtctggagttttgagttcctgactctagcaacagtactctaaggccctgtttcttgactgaaaatgctaaaatgagtctcctgttagcctgcaggcacagcgggacccaattagcttcttcaaagatgctcttccaggaacaccagccacattttttaaaaggtgaaaaagaatttacactgaaaataactatccattctccaggagagtagtgtctcctgaaccttccccctcaaacatgtttgcattattggttcattttcaaggaatcattttcccaccaatgtaagtcagtgcaaacctcttccttgaagaatgagcttactaacttctccacatccatttgtacctcacacacctacctgatgataaccctacttaagttctacttaaaaaccatccaaaatgtgtggctctggtccctgggccactagaaggtctagaagaacagaagagactgacacctctattaactcaattccaaagacttctttagtcaaatttccaatctgttttaactagaagcctgctaaaaacacaagatgtggattgttcgtccccaagataactaccatagaaaaaaagtttcatctcaactgctttgctgggagaattgtgaggctgtcccatttcttcacaaaatgagcagtgctgccatactgaaagttaattttggaatccagaactctgttggcaagaatgctattcacttatagtaaatataatattcactattatatcctagatataatatctatatccagatattgacctgggtgctttcccaatttttttcatggcccacaaagaatacaggatatgataatgtctccatgacatgctggggtaagtggaggtagttgctggggcttcagcaagcccaaccactgcccagctgcacccatggctgagtgtactcatatccaggcccagactcactcatggcccatggagtgcagtagagaactctaaccaggaaaacagaacaggtaaggggggaatgtatggcaaatttaccttccaacccagtccactgctattccatctggctgcattacgtatttcagtttcaggtcaacttcctgcacaagattattgcggccggattcaaagttggggatgtaggcacgtttgatagcaccaaacctagagccctcccctcgcacagtgtaatacacaacacctacagaggaagacacacaggtcagtttcatgtcaagagcatcaagtaaaggaagaacaggggtctaatcaggtgaagtactgttcgtttattgacatctctacctccctcctcactgttgttataatatgaataattcaatgacatcagtataatcaaactttaaaacctatcaaacttgagctatgagctacaaatgcttcaactgagaacttagtgagatttagtcatctctatttaaaagtgattcatttaaacgtatttcaacaaagtgcttatttactcttattaggatcaagttctagtttccaaaacagaatgtatagagataaaccagggcaggctgttgagaatttgaaagcatactcaagatcagaggcaataaagaagccatgtcaacgagaagtcctattttatatacagacagaaggatggtggacagcaggcatgttaaaagcataggaagactgtgactgtagagggatgcactggacacctgctgctttcctaggtatgcaccattcttgaaaagtgtattgtattgcatgaatatgtgtgaaaatacaccaataataaatcctacattggtatagttattgatagttttcaaagcctttcatatctactatctcattcaatcttccaaacaactctcagaggtaagcagacagaacaagattactactttgattttgtagaaaaaaaattgagattcagagaatcgttacaattatttaggatcacaaagctagtagataagggagactggcataaaagataagtttacaggcacagaagacaagttttctgactcctaccctactgtcatctcccccaacaccagatagagccatgagagattcaacaataagcattattcatctttttccttcattcaactaaattttttgatcacctaccacatagagtgtactagatgttgggtcagctgctaggcatttagagataaattagattcagtctttgtccccaaaaagcagatgtctagaggatagaaagatattatgtggtcaactagctatataacttagagtaacatgtgccataaaatgacatagattcatggtgagcaatcatagaactctgccagaaggagtgatagaagttgtcacagaggtggtgacattaaactgggtctttgaggtctgagtagaaattttcaaggtgtacaatggtaggaaggaacaagatctgcagtatcaaggacaaggaaatttcaaaatacaagaagatgtgagatggtccagaaaggataaaccccagtgatcggaggagttttagaaagaaatcaggaaagcttggctgggattcaaggccacgctaaggcatcaggagcatgctggattggaagagtttcctcctccactaatgcaacaaaattcactcattaaacaataaattccttaaaagtcaacaccttaaaattctataaagtcacttaatatcaatgaaagatgccaaagtttatactcactgaggcctatgtccttgggatcccaatcataatcaacagcttggatatattcctcatcttgaagatactctgagaacctctcagatgagagattatattttcgaattcggacattgtcaggcagtagcaacaaaggagagctacctgtaaacaaacaaagggctactttatctgtttgaattatactttcctatataaagtaggatataaaatgcacagtatgtacctgtcccctttttaaagaacatgagtttttataggaatctgactatctctgttaatcaataaagctgactctccaactgggttacaaaatccgtgacttgacattctccacttcaagtggaaagctaatatgtctcttagggacattatcagttctttattctttgtactcagtggtagtatggaacaaagctagactgagaaccctacgtacagtcctcattttcactgaattgtttttatttactgacatcaaaacagactagactgcagacattctatctcacagaagaaatacttttatagtcttactaaaagtttaccagaaaagtctcattccttactgtttcctgacagattttatgattctttttagcaggtaatcagctctatgacccaatttagctcctagctaatgacaaaataaacctagcttgtccttgatttaatttttttaacctaaagcagctacttaatggtgactcatcccaagatgcactgtctagaatttgttaagtttaatttacttgcataatgtcaactgaatccaatttaagtaacttttaaaagttcattttatatatttcctctatcttgacattatgttttatatgaatattccaatttgtttcagtcatgtccttagttaaaggatttaaacatttaaaaaattgctgcttaattaccagaccaactgttcaaatgctttcactctagttttcattcactgtcaacagtgttttgagggtaaaatatgtaagtatgctagtcaaatgtatgctttaaaagctcaatttgtatgaagaaattgaacagccattttggccatttactcttaatttacaaaataaagtgctattttcttatcaagttccttaaactctagtacaaacttcaaattcaaaataaagacccatgcctcttaactaggatatgatgatttagatcaggcctctggaatttggagtataatacatctgacttacattctttctctgttttattaggcccgattgtcagacactggcatcaacctaaaacgtaaaactcatgattgaagttatgactgtgccagactcctttctgcctgtgatcagtagtccatgaacaatacaaaagggatatgtccttgatttgccccaattcacgagccctcttggactactgggcctcaaatcttattctcagtggagtgggagctagagggccttgttaccttccttttattgatgaccatcccataggcaagcttttgttattgtttgagccttaagaaagatgacatcttgtccactttttgaagtttttatcaaggtagacaagaggctaaatccattataataagtaacacctggctcttgttttaattgctacatatttgttgggggatgtagctattgttttaagctggcaggggaggagagagaaggagcgactaaagaggtgttggaagagaagcagctggcgagtttaaaaaaaaagaaagaaaagaaaaactatgagaagctgaagtttctttcatcgtatagtgtacttagcagtatttatttccccaaaagtcaattaatcccaacatgaacccatcataccctcagctgcacatcgttttccagggcggtcactcatagacgtgaagccatcagcacagacacactcataacttcctttggtatttctgcagtgctggggacaagtcccaaattgttcacattcattgatatctgtaggcaaaataaaaccaaatacgcaacatctgttcccatccattccttagagatcttgcttctgtttaaacccatattcaccagcaatgaggaccgagaagggtacagatgaaaataagcaatgatacaaacatttgtgaaacactaagtttcagatactgtttcacatgcttttcaaatattttcctcgtttagtcttgccaaaagactttaagaggtatggacgattaagcccacagtcccaaagctgataagcaatggagacaggatttaaactctatgactctgcaatagcagagcacattttccctttcagaaggcatatgttgtgttgtattgttcggtgtctcttcacttctgctaaccagcttcaggaacaggagtcattgatttagtttttcaattgagttcttaagcttcaagtccaaaaggaactcttacaatcttctgactatgacatatcatgaattagaaacagtaaattcaaatactaaaaggcacctaaaatcatgctcatcactcaccatcttgataagctaccttctgactccataccttacaactcatctatgtctggcgtaagtaggtgtataataaatacgtgttggttgtttgacttacaatgaagaaagtaagcctagtttgttttttaaattaactttgatttcacacactggtgcaataagcagccatcatcaccaaggccttcatcattcatatcaattccacagactctactgagcacacagtatctgacaagcactcaggtaggcactggtcagatagcatgcatgcaggtgggggaaagcaattcttgagtagtttaatgacctagaaccatgaaaccatgagtatggtaccattaagggaattaaatagtgatttatttaacaaaggggagtgggtggagaaccttagatgtaaagttcacctaaacaggaattggaaaaaatatactctacctagacaggaggttctgtcaaaaacattggtttcgaacccagctgtacaggagcagataaatcctccttcatttaattgggtacaattttgctcgcatatattttcagcacatgttctttcttttcctttatctgaaaaacaaaatcccagcattacaaaccagatcagccacaaataacagtcaagtggtgtatcaaaagaagcacctactcgtaaccaactataggacatcttgagataacccctttccataagccttggagaggacagagggcactgggggagtcaggattcctatttctgatcgtgatctgaataccatttagataaatgcatataatgctaaaactttgaggcaattttcacattatatgcagcactcctaggcttatcctcagagcatccaattctggactgcacaactatgaagcctgacactctacagctattaccacctgctctactatctttaatcctattgcaaatagatagatcaatagatagatagagagatagatgatagatcgatagatagataacagatagaaataaataaataaataaataaataaataaataaataaataaaagacatggatacagataggttagaacaaagttacaaataggaggaaattataaaattttaagaagactataatttccctaacattgaccaattgattatatacacacacacacacacacacacacacacacacacacaaatatatacatgtatatcaagtgttgaccagggtgcagtaaaatacatagagttctaaatcatacaactgctcttagagccataaattagtacacaaggaaagaaattttgtactatgtatgtatgcaccaaggactttaaaaatattcatactcttttacccagttattccatgttaatgaattttcccttgagaaggaatatgcagtataatttacgtttaaggattataaaaatatttacaataagaacatttgtttgtaaacaacttgaatgtatgttcagtgatagggaataaattatgttatagtataaaaaaactaagacattaatgatgcaccattactttatgtaacactaaaattgaatatgtctggaacttacgctgacatgttattaattgtaagatatatatcttggtttcaaagatgttaaaatataaaaaaatacatcttagaagcaataagttatgattatctacatgatgaattgctatgtgattattaaaatttatagtttcaaatgatactttgacatgggaaatacctataataaattgaaaaaaagactgaaaaactccatttagtatagaatatttcttaatttttcaaaatactaagaaatatttcttacatatacatatgcaaaaaaaagatagcaaaagtacaccaaactttaaaggttagttctcttttagtgatgggattcaaatgatttttacttttgattgttattgaactttcacagtaaaaaaaaaacaaaaaaaacacagtttatttttgtagagcccatataaatgatccctgttattctgatccagatgttccaagacagacttttaacagctcacactttaccctaacacttcattgttcatcattgccccaagatcttgtctctaccaatatctatccaagccatctggctttcatccttgtcattcttatcagtttgcttcttttatcctccatctatccccaaacctaggtcttacagaaaaactggcgaagatgaacatagatagtgagtgataatgggggaaagagaggcagtggttatctccattaaggatttaagcttcatctacctctcaaataaaaagtctcctggtcataggcttctgagtattttagccaaagagactgtggtatctcctgatttaattctttcaaatcaaaatagatttatatctatctgttttccatagtatgcaatgaggtgaacttaatcactctcagagtcctttagggtaaatgatcatatcactatatgtggtctgagtacattaagaacactgggtttcaaaaagaaaaataaccaaaataaagtacaatgaaattcaatggaatgctgcccttggagtgcagacttcaaagctgtatgcatgaaagtcttataataaagatcctagcctttattataggagctcttaacaactgtacattgttaaaacatctatttagattttctatttttttcatgagccattttcagagttttgtgtctttctaagaatttattcacttcacgtaagttgtttgatttattgccataaaatttgtcatagtatttccttactgtcctttgaatttctgtgagattagcagtgatatcccctctacattgctaaatgaatctgacctatgtttattaacttggatatcattgagccagtcacataacctccatgggtctcacatgcatcactagactttgtaatttcctcctagctctgaaatctataaagggattaggggtcccaggagtcaagaatttctggaccaagtgatccactaaatgagtcacccttttgtgaagcaagagtccttaacaagagcagaaaccacacgacactgtaggattcttcctaaaatgtgagggctttcttatcattgttttcatttgaaaatgatcaccattttaacccgtataactgatttccccaaacccaaacatatggcactctatttataaaagaaataccctactttccattttatgaagaaggaataagaactaccagagaaacagcaagtcaatctatctttatgatcacataaataatatttgcaacctgaggttaatttctttcctttatacctgaatggtgctagaaaaaatgctaatgtattttcattcccaaaaatttgccaagacagtagactttaggtgctcttaccacaaaaataatttttttaaagataactatgtgagataacggatatgttaatttgcttgattataacacatcactatatataagtacatcaaaatgtcatgttgtataccttcaattttaaaaaatcgaacaatgtgtcttaaacacttcagtgatgcttttggagaagaagaagatgaaggaggaggaggagaaggaagaagaagaaggagaagaggaggaaggagaaaaaagacaaaggcaaataaattaacagcacccaagaactagtatattaaaaaagaattctatgcctcaaattattagtccagagaaataagactgaattccatgtcacatattcacttaatatctgaaaagagaagctgcttccatacccgaattgtttgtgctacttatttccttaaaaaaaaaaaaacctgctactaattaaatgccatttgaaaagaaagtactgtagtctattttaagccacctatcagtctctgggagtcagaacccaaacctgccattcagttttgcaaattctatcatgttcaggcttttaaaatattttatcaagtcacttcattctgtcaataactccaagtcccacagaaaacgtatgtgaaataaatggcaagccaactcaatatggctggttattcatacctcttcgtaactcacgcaggagaaaaattgatagaaaatcctttggatgcctcaggaaaaagtcaattagagcccaagaagttgaaagcacatggagctcactaggatgactaagtcacaggctcctagagtttggagaagggcctcctttttcctgtgaggaaaccaaagactggagaggtcagtatgtgcccaaagtggcacagctagtggcagggatccagaggccagccctcctaacctggacttacatgactgctccaattctgcctctgacattctgtgtgaccacaaggaagttacttaagctctctgagctttattacatagacaataacagcaactcaatggggctaacttgagtaacacattaaataatgtatgtgaaagcactttatgagtcataaatggactacaaaggtgtgacttagtaacatgtcattttaacatttccatcaaaatattgagctagaattgttccttggttatgttcatcatccttttcctacacaaagtgctccctctactttcttttttgtttgattgtttgtttgtttgtttgttttgagacaaggtcttgctttattgcccaggctggagtacagtggcacaatcacagctcactgcagcccctacctgcactcaagccatccttccacctcatcctcttgagtatctgggactagaggtgcacaccactacacccagcaaatttttgtgtattttgttaagacggagtttcgccatgctgcccaggctgttcctgaactcctgggctcaagagatttgtctgcctcggcctcccaaagtgttgggattacaggcatgagccactgcatccagccactccctcaactttaaaaataaaaataaatgtcccttcccaggtcccctgtggcgttcccttcttgatcaaacaccctcagaaggattttcaggtaccaaggatactgcatttggcttaagatttttttcatgtatatactttaagttccagggtacatgtgcacaacgtgcaggtttgttacatatgtatgcatgtgccatgttggcttgctgcacccattaactcatcatttacattaggtatttctcctaatgctatccctcccccatcctcccaccataatgtgcagactaataaacaaaatatgtagccttaaagtgctaagaggcacccagtggactgggaagaggacttgctctgcagtgaaacagaccagagttcaaatcctgagtcaacctcttaatgacagtaagacctggccaattcgtttaacctctaagttcgttgctcatttgtacataagaaagagataataacatctaactcataagattgctaccaggcatgtagaatgtttgacacaatgtctggtctaggataagcactcagtcacagctagctatgggcttgactggaattcaagcaaaaagtacattaaggagaaaatgtggtcagtgtctacattatgttattgcatgttttaattaggtaaacctgagttactacaatgaactataaaaacaagtgtttacttactgcaacccagttcatcggaccagtcaccacagtcatcggcatcatcacacacattgtcatgtggaatgcaatgcccattgccacacttatattcatattctgtacaaggtttaggggtcggttttctacctgcaatgtaaaaacaagttaaaatcaaaactttttcttttatgaagcaagatacttccttctttgacagagacagtttgtgcttaccaaataaacaagtgcttccctacatttcccagtctcccttgcagctgggttaggaccatgtgaccagttctagccaacgtactgtcagttggaggtgccatgtgtcactactgggctgaagcaatgaaaagcacacgtgcctcctccgtgtctcctgtgctgctgcagcaaccttggaagccatgtgttccaggcagcacagctgcaagatgcaggagggctgtgaaaccagcgttggcctttatgagtgctcaataaggcttcattatgttacacccctgagatttcaggatatgctggttgcaacagctagtattaattactccgaataacatagagtgatgagggaagtagagtactgccataataaaaacataaaatatttggcattggattaacagtcaggaggcaagcaacaaggacactgatagtggaggcaggaaaggtggagatcatgttatgcaaagtcaaagcatttgataaagctatcacctcggaaaaactggaaggcagatcacatgcttactgaacctgtcaatcatggagcgaggttagaagatagaatgttagtaatgtgcattgattgccattcctgagtttggcaagatagtataagaaagagagaacctaagggaagaactggttaccttacaagcagaaataaaataaagcccagaaatttgctgtgtgagaaaagccacctgtatctacatcccaaacagtaaaagtctgaagtttaaaaggctgtgagacacgaaggcccaataaaacctcctcattggataaaatgactgcccatctatttttctacatggattggatgtaagtgacaataagttcagacagaactctatgaaggaaagaaagcaaagaaaaaagcagatttgagaactatgtctccaaaagagcactaggtcaggttactaacttttagaacaggctagaagcaaacagatcaaatgcctggtatgtttctgagagaaagatataaccaaataaaccaaaatactatgactgtttgagacttggaaaaaaaaacaaaaaacaactcctgggctcccgaccttctataagcaagaagtggggtgagaaagctgccgtgctggccctaatggtagcatatttccctttccctcttcatttgcagaggaaaatagacaagaaaaaactctcaaagggtagagtcagaaacagtgagagacattttaacacaggagctcctcccagagcagaggcatgagctaatcaataaataccctccactccccaaagaagggacctttacaatgtctgcccagagtggccatgtaatttactctcctttccaagccagtgtgcttttgaaagtgaaggtggtgctattcataattccactggggcagcagacatgaatcaggactgtcctgtgctaacatgtgtcatcccagcccagtgggacttcagaattgctatacattggtgatggccatgagtctccaattctttctttccaatgggagtgtttatttctattgtgttgcccctgttccgccaatacctatcaggcacagaaggcactgattgtttattagtttatgggtctcccaaccaagaggaaccacatctggaactgattgagtggctactgcccattacccagaggtcctggatttcagtttcggaatggactatgagctatgtcccttgggaaggggttaagggtgttctgtgtgtgagaagaaaatcataaaggagtatttagtgacacaagggtaaattgtatgagaatgcatattcttgcattttccagtctcccttacagttagagcagggccacgtgactggttctgaccaatggactatgagcaagaggatgtctgtcatttccaggctcaggaagttaagaagctgtgtgcctccaccatgttgatcttctcctgccttggcaaccttgaatgtgtccctgatggcataattatgggatggaggagggttgcttgactgtcattaaactttacatgagcaagaaatgaacctttgccattttaagccattgaaatgttgcaggttgcttcctgtggtgactggtagtggtctcccagactaaaaccctgttccttgaaaagaatagaagtttatggattcttttttccactctgggatttgaccatgtgctacaaatgtcttgctccattttttaaaaaatggcatttttagcaggggaaatggaaagagattttggggaagggggaaatctgctcaaattctttaaaaatattttatttctgggctttcatgcttttgcgctatgcctcaaataaacatattaatgctataatgtattaatgctatctctgccagtaataatgataacaggaatacgaacttgaaggttgtggtagtgtcaaagtcctccctgacagtctcctctgggatgggggctggaagtaagcattctgtggcaaagcgttctaagaccacatcaatacaagaaatagaaagtggagaaatcaggcatttatcttaattttcccagataatgtctttttggggaaaaaaataattggagtcggggaaatgattttcctcactgacattttctaggcaaattaaattgcccagaaaattggtcaactttccccttcaatggatagattttaaaacattttgaaagtgcagaaaaagtacagctatttcaatgcctcgattgttaaatgcagccagtttggaacttctatcttaaactaatctatcacttttctcttctgggaaatgaactttcattttcaacaaggatattagataagctctgttaacaccagtgctgccttgcttcacatgatctctgcagctgggcacctgcctagattagcaattagcaactcctgaaggctgaaggatgatcaaatctcatatttgaaaaaataaactattaatttgcgaggtgtggctcaatcagtatttagtgtttgttctcagtttcttatgagaaaagaggaggggaaggcttattaaatgttcaaacaaagactgaaaaattaatggatttgccagcatcatgctcaaatgagacaggaagaaacaggcagggttacatgtaagcaatgcatgtgtttgcatggtcttgtaaacaattatgtcagcagagatctgcagtcatgggcacaactctatagaacaaactgaaatcccagaggcacattttccaaactgcagaccacttggggtccttcctttttccttctcccttttgacttttgcttacagtgctcctctgtctcatcagttccatctccacagtcatccacaccattgcacacctcatgactataaatgcagcgattgttgtcacaccggaaacggtttggtgaattacagggaacatccactgaaaggaaagatagaaaaatgaaattacaagttaacagtagaatctaagtgtcaatatctaaaatactccagtgtcagcaccaggcttgcttcattcatgcactcatttactcatttgattaatcaatcagcagatacaccttacatgtatagtacacaccaaggcactgtgctaggcagtagatatgatgggaaacaagaaagacacagtccttgtcctcatggaactttcattctagtagagaaacaggcttttcaaattaaccattcaattacaactatgaaacatctactggggtgatctgacttaagttagggagaggaaggcttggaagaaacttcccatagattctgagtcagagaggaggatggcaggtctctggacctgaataaaggcctcggtggctggagcatggatcgtggagcacaatggtggctgtgaggctggacagactggcagtacatggactcttatcctaacagccaggaagccatttgtttgatcctcctgatggcagttgtcatagagtctctaccgcatgagtcttttattgaagctttaaattgtgttggattttccttcctgaattccctcacctcttacatttaaaatcgatatctcacaatcaaaccctgacacacttgctgtccagagtgagacctctagctgctgcctgtacagatgtgaggaactcaagggtagtccccaggtcccctacttgtttggtacagggaacatggttcactatgcgtgtaccacaaatgcagtgaactcaacatacatgtggtcttcacatgtggtctgtctttcacatggaggatttgggctgtctgattttccttccgccttggtatcacacacagggatcaagaggagagacttataataagattggttgaggggaaagggtcagatctaagggctgattcttggaagtattgttaatagaactattgcaataattatttgctgtgaaaggcaagttcaatattataaaacagtattggaaaccttttaatgtagctgtgtctctgactctccaaagtttatttttactagctatgggcattttaccttatggagagaagagatttcctaaggacttctttgaaagttaaacatgtctaagatgtgtctcaagattcatgaagttcaaagcaaaacaaggctagttcctaacaagtaaagaaaaatgttgggatgcaactgtgaaatataatgaacactaattaaagttttctgaggagaaacaaaatactaagatatatcatcttcacaagtcaaatctctgggctaaaaatgagtagtgatgaagctgggaaaggggatggaagatgcaacgtgaacttccaacaggagtgcttctccaggtcttgtctcctaggttaagggcttttacttacacaaaatcctgacactttagtttgcatcagaatcatttgaggggcctgttaatgtatagattgctgggcccttaattttcccacaaaattaaggccactttggggaaagagctcaaaaagcagggtctttgagttaatgcctttccttcctctacttcttttggtcttgatttttaatttctatttggatagggtgcatcccatgaatttgcatttctaacatattcccaagtggcactgacattcctagtccaggtaagacacttttgagaactattaccctagagttcctccaatgactcaaagcatgtagcaaaatgactgcaacaaactctatttacgttcacttcattaaaatcagtagttctcaaccaggggactaaactaaaaggctaagaagccttttaaaaatacgtatgtgcaggcttcattcttggagattctgctccatcaggtctaagcctagggtgaggccagggcatgtgattttgaaatacccctcctcctctgctactgacatgtacctgaattgagactcacaaacaagcagggtttaaaatatatatatatatatatatatatatatgcatcattcagcaagagggaattagatggccttgaattaccatgttaaaaggaagtgactgtaaagattaagaaagtcttagcattttctaaaggtgctccaggaagctctaggggtttggagagggtacttcaggggcacccaaagtaggatacagcaggagaggtacagcctcctccctacccttcctcagacttcaaccacaacagacctgcctttatttatgcatactaggttttcaagcaacatttcccttaaagacattgttttctaaggccataatacatttaaaaacatggaggttttcccaactttctcaggttacagagagaactgaagctggaagacccagtgaaataacaccaacgctgatcctgtgtccattcctaaacaattgtacaactgctctccaggctcacatgctacacgtaagaaacaatgagatttgacagacaacaccactcccattcactccgtttctctccctcttacagcacaggtgaagttcttcatctgaaccatcgccacagtcatcatcgccatcacatttccaatatggcgggatacaaacatggtttttgcattcgaacatagtagcctggcagtatgcaccatcaggaaagcgtgtggctgccatgggggaaaaaaacatattcaaattattatacaaattgactactttggggaagcttcctgctatttctcctttggctcttgccattatagcctgctcttctttattcatcaagatgtatagtggccttgacctgtctgaaagttgaacggactatgtcttaagggcagttgtcagagcccagtcagtttccaatggcatgaatcatccatggcatggacagcactggacttaatctctacaggcaaatgtcaagactggttttacccacatacatttataaagtctctttggcaaccacatcatcaacgataaccatcatggatggttatcatggatgatggttattgttgatggatcagcaataatgatgtataaacagtttgcattgattcaagtgatccataaagactcaaatctgagtaatcatgttggctttccagtttttgtagggaaaagaaagatcagacagttactgtgtctatgtagaaaaggaagacataagaaactccattttgatctctctcagtcttctcagtctctcatcccacctgaggagaaatacctacaggtgtggaggggctggcccccttcaagttttaatcatttttatactccatcgtgtgactgagaaaaattttaatgctataaattcaatatgttcgaatacccaacccaagttctttatactaatgtattcgttgcttgaatatttttttacctgaaatgttttttatctaattaatgatttgtatagtagctgataatatataaatactttgttagcacagattacttaatatattctccatttaaaatagcaaggaagtacacttgaacggccattgtgaaatgtatgattatgatgacttagaactcaggtgaactgatcattatcagtgcatgctgaacagacaatacttatggccttttaatctaagaagcggcagcggactgatgtctaaactatcatatccatgctctcaggtaagcagtactacatatgtgtctagggacttacgacaatcagcttcatcagacgcatccaaacagtcagcggatccatcgcatttcagttcactgtgtacacaatgtccacttgtacactgaaaatattcaggatggcaggtcctcatctctgaagagaaaagattgtcattccgagaaggccttgtcattttcagacagatattaggtacctggagtatagtggttactccatcacattcctatctacaccctgtgactggctcacagcaaacccacaacttgtggttagcaaattaatacattctcaaaactcacactttccccactcaacatacagagatggaagtacctagctccctaatattaaataatctccagctcttaagcttttcctcagaaatcggaattccccaatcttcaatgttttctaattttcctaagacccaacaccaaatcagtaaagagctataaaaattactttgggtttaggattactctgtcaatgatctgatctctacacaagagagtcataggagcacatgcatattccttagggtgactttccgtggaatagtagcaagatcaatgtctttgtttacaaggctaacgcagattaaaatctgctcctaagaagtgttgatattaaaattaaatgtttaaaattccttgctattttcctcaattatgactaatctagactgctatgagttaagaataatgcatagaaaatacagagcagaagatactgtgttatgctaaggtttacatattacacatatacaaaaataattttcctctaaaagccttataaacactaatttgaagcccctacactgtcacagtacaaaattctatggtaagcttctcaaatgacagttaccacagtcccgttcatctgagttgtccccacagtcgttgtaatggtcacagatccatcgcgagggaatgcactgctgattgacacatcgaaactcgctctctgtgcactcccggggagctggaaaggaaaggcacctggccatgagtgtgcaccaggaatcacatacaggagacatcttgtgagctgaccatagtgccctgggtgcccagcaccctcctgtgtcccaagccccagaggtgtgcttgggcaaatcattcaccctccaaaactagacctttcaccttaattttgagtctgtaaagaatggcctttattaagaagtttgtccaaaggtgatctgatctctctttctctcttgctctctctctctgtttttttttttttttttttttttgaaacaggatctttcaacattgcccaggctgactttgaactcctggtctaaagtaatcctccctgctcaggctcctgcgtagctgggactgcaggtgtgttccaccatgcccagcttgattttatcttaattttttctatttcgtgaaactctagataacctcttataggattcaacattgacttttattaataaaagacaaaatgccaattggattacccttttgtataagtttttagctaactgatatttgcaggtgtagtcagcttcctaaatctctcattgcttatcgcaagtggtgatcacttttttcttccaaaaggtaaacaaagttagaatgtgtttcattagtcaattagaaattgacgcatatcatgggtcagtgatatacactctgggcagggcttcattaagcttgttttcagaacacacattgagtgtgttctgaccatctaatttgatatgatctcagcctcttggcttcctttcctcaacctccctatccaatgccttgtagtcaataccttcgactgggagagagaaactaaaacctgtcctgttaattaactgttagccctcctaaaatagtcaactattctaggaagggtaataatgcaaacacaagttctctctcctctcctatgaaggccattttggggaaagagcttaagaagcagtgtctctgggttagcacccttcctccctctacttctctggtcctggttttctatttctattctatttatcttattacatttttcctttatcataagtcacctcaacttcttttggaaaaaaaagttggatgtaaataaattcaacacataaaagatattcttcagtaaataccttcctccaaaagcttgatttgaaacatctcagaaggagatgcttatgtctttagtggaagagaaagtagaaatgtactgaccagcagaaagaaagagatcagacagcttgatatcatcctacccattgaggatcaatgacatagacagttgaattatggacaaaaagcaaacatcacagctctggtggtatataaggaccataggactgtgaacactcaccacagttttcctcatctgagttatctccacagtcattttgcccatcacactgccaacgaagagggatgcagtggtgatttttacagcggaaatcccccacaggatggcatgtcctctcctctgcaaagcagtcattgcaaagacttcataaaccattggcagagaaatgcacaaagtagtattggcttccttgtgagacagtctgagaattgtattagctcactcttgaagctcccaaagagaggaatgccagcaacattcatggtcaacattccctcttttagctaccctgagcctatcctaccacttgaaactcgatccattcccattggtagaaaccatgcaaagaatgaaatggtatctggtttgtaatttgcaacaaaggcctggtatgggaggctaaaatgatgccataataaataaatattttgatcatattatcttcagtcaattggactcagtgttcttaaaagaatttagtatcttccttacttctcttccaactaaacccaacacacatactccagatgctttggtttcaagttagactatgactaatcttgacaaattccattaatttatctggctttcccatgttaccagagagactacagatgtccaatagataacagggaaaatcagagagacattcagaatatgaaaatccccaaataagaaatatcctaatttggaaatatcctttttagagatagatacgaagtcttttctctaacccctttccaccaatttcaaccaatttataaaattagagaaacaatttaaacttgtcaagtatgaataaggattctacatttggaagaaattacacaagtttctaacatcttaataacgtcttcctcaatgacagcatgacttaaagtgctacaaattaaatacccctggtaaccctgcaaaatgctacaaaaatgtaacatgttattagaagaatcaaccatttttttacagaggtaaacaaagaaaagatgacatgggaaatacactctcatctctcatctaataaatggcacttgacatgtgcactttcttgtccctccctccactcccctgtggcccctcctaccacagccttgctcatcactgttgtccctgcagtcatctacaccattgcacacggcccactttgggatgcagcggtaatttgttttgcagctgaattctgtgaagttgtcacagagatgggcagagctcactgaaaagggaggaggcatcaaagtcagaactgaaggtacaagaaagcacctttccattgtcacattgaggttgtggtactgaggaataacaatgaccatgttaccaagcaaaccgcctctggcgatatgtgtctgttttagatgtgatctgtttaccatgagcagaaaaatagtcctaagttttctcaatatgtcagcaccactcatttgttttacagtataactttgtgggtggggttggggaaggacagggtttgaagtaaaaaacctgggttgaagtgttaggtctgacactaaacagtaatgtaaccatccacttaatgtgaacctcagtttcctcatctgtaaaatggaattggttcacacccaccttccctacctcataacatttctctgtggctcaagtgagaaagcagtagatatataaaatataagttcttggtatcatattctggttggttagacattctatgtatcaaaaggaggtattagccacttcagaaacagagtctggttccacctgcaagccacacagctatactctgccttgcagtgccagagtttgcagggagtgccaagggggagcatcccatcagctgaaaaagaaagctccatgtcctctctcagtccccatggaagtttcctcgtgtctccctgctctggtcatgccttggtcctcccacaggaacttactgcattcttcaatgggctcatccgagtggtctccacaatcattatccacatcacacttccaggcctgcgggatgcagcggccattagcacaccgaaactggcccggccggcaggtcctgctggcacagtgggaactgtcttcatctgagttatcctcacagtcgttaaatgtgtcacactgccaggattctgggatgcaacgtttgttggcgcactgccattcattggagtcacagtggtgattctctgagagcagggacatttggttatcagcttggaaggcatcaagaatgaaagctcctaattgacatcagtgaatcctggatagcaggatcatgatttctttttagaggacttatttcctaatgtacttatcagtcagtactactacatggagcacttcttcttttgactattactgtctcccaaattcttaaatatctctttattgcatacagacttaagagataagaactgaacaccctgacctgttaagcataccttcctctgtccctattctcctactggaaaatagtcttcaaactttgtgtttgttactgttattgatgtgttgtttttagtttgggggaattttattttgtgcctatttgattatttatttattttcttgagaccaagtgagtgcagtggcacgatctcggctcactgcagcctcaacctccaggatcaagctatttttctactgcagcctcccaagtagctgggattacaggcacatgccaccatgccaggctaattttttgtattttttgtagagacaggcttttgccatgttgcctaggctggtgttggactcctgggctcaagcgatcgacctgcctcagcctcccaaactgttgggattacaggcatgagccactgtgctcagtcttttttttttttttttgccttttaaatggaaacataaataaatatgacaactgagagtccctgttaaaaatgggggtggaaacctctcgtttcctcctcaatgttagctctcaaaggggattcaatgcccagcacatggtgaagagccaccagtagagacaacttattgtctacttcaaccatttgccttgtaaaaaccttaagatttctaaaaaaaaaaaaaaaaaaacttcataaaaatagaaaaaggatggagcctgagtttccttctaggactttgaactggtttttagttcatgatattcaggaaatacccacagaatcatgatcgtatacaatcaacatagaagtcggaaaaagaggcataaagcgactcaacacaccacaaagaagacggtcttcatcagacccatcagggcaattttggtgagcattgcataaagtctgcgggctggtgcagttgccgtcactgcactggaactgtcccagtcggcagaagcgctgcgggcaaagggccagttcatcagagccatctgagcagtctttctgtccatcacatttccaccagataggaatgcacctgcacagagaacatacagcacttctttagcaaagcaccaggggcaacagttatctggagagaagaagtcaacactgaattccaagaaatgacatgcatgagctctctcgtggccctagaagaggatcaattaaatctcagttacaatggtgtattttcagagaaaacataacttggcaagatagaacaggtttcttaagatccaaatacaaactgaaaatgtgctcttaatatgatgaataaatttcctccacaaaaaaaaaacaataaacaaataaagagtgggtgttttgagctgtgttctaggagcagtgattggttgagattgtctgccagggtgatataaaagtattgtttgggaagttggagggcaataaaaactgttgagggtctttctcacgataaatgtatgctagattcttaatctcagatatcttatttaatcactacaatcgtctacctctgcatcttagatgctatgatctgcattaatgcctctctccatgccactctctaactcaggtcccctagttatcaatgggcctgtggacattgttaagaaaataatctgtggccatgtttcatagcaaacacaaatgatcaaaaatggatttgaatgtgtaaccctggatcccctagcataggcagctaaggagctaggccggcatagacatggaaaagacagtgaaattctattacttctagggacaatttttcagtatgtacttatatacactctggctccaatacttaagacaattagaaatgagaaatatatggtttgcttcctttctatgaaagtttgcatatataggcataacagtttggttagcaagctccttctattcatggaaaatattatctgaagttggaggctgagagtcttgctgtgttccacatgaaccaagttaattaaccaaaatcttgtctcactagaaaactcccatcccttggagccttgaaggtcaatgtctgtccacgggctagagaggcactgaggagaggggaaagagagccttacttttcattgttagcgcacaggaactgggtgctggagcacatgggcatgcagtaggtgctgccactcagctgaagggtgcggaagtcatctggacactcgcaagtgaacccttttcctcctggcttgatgaggcagagatgagaacagccaccattgttggtaccacagggattgctcactagtggaaaaggaagaaaatatgtgttcatttgctgaaagagagtatcaagcacagattagctgattacacatcttgactttaaactcatcacctcttagtaaaaaaaaaactatcctagatttatgattttcccaaaagttcctaaataaaacagatgatagagttatacaagcaacaaccctgtgctttaagaaagctcatttatatgctaccagaagtgagctatacccactggtgtttctgactagaaaagatgtgtttctccaagtcctgggaaagcaggcagtaaacttagcttatgttcatttgcctagacctaggttaaagttttaatttccaacagatgctatattcattccctcattctaagtatacaggtaacaagtttggccaaaaataatgtggatgaataaactgagcagcatctttactaattttcctggtcaccactttgaggtgaatatttgcttgaacttctaataaaaatgatatgaagaatattaacttccagaaagaaatactaaatttctttattttgctaattctcatttttccttaattccaagtttatcatatgttttagcaagacatcacaacaaagcagacccacaaaaaccagtctatccccaaaatatatttcagacctttatctttatttcagactctaaatcataaagttgctttaattgcataaaaggaatataagttcacaatcaaataaaaacaagttctcttacttaaaaaacactaaaacgcactgctcttgacattatcttctagaagataagaataatatctaatttatacacaatacaatatcatatgcatttatttagtatttagtatttagggctgaaatgccatatttttaattcctttaaaatacttcagtcttcccatagaaatagatgaagtaaatatggcaacatgataactgttaaatcttatcaaaaacaaaggaaaaaaaaaaagatgatcttgaagaattgagcgagttttaagaagatgaagagttctaggtagtctttcccaggggaagggggataaactctaaagatatttgcctactgtcaactttcagcatatgctttgaagaaaacactaacaagtgcaacaaactttttgtaaatcacgaagttcatgcttaaagacaatcatgacatgcacataacccaaggcaaccttgccaaacccctcaatcacctactcaccaatgggctgcctatatggatggtacacatggatgtcaaatggtctgtgtgttgtgttcaccagtgtctgtctatttgatccatcatatttgtttcccttttccactgtccttgtattccaatctgtccaataaatagtgtcttcaaaaatggtaatagcgaaagggtgaggcagtgccccatcatacaccgtgtgtcgatggtggccctccaaatcagagtacctgcagcagtaagcagaaacagttatgtgataaaggtaattcctctcctctaatgtcttgcaggataaaagaattcacaaatcaataaaattctacctcctagagataatataagttcagatcctcaaaactcctagtctttaattaaaacaaaaattaaacttaaaggatgaattcaaattgaacaaaagatgtagaagtgaaaaagcaatacttaacaaaataggaatagtgtcaggagtttaaataatcactaattcctaaccacagctgctttcctgcggatgaagctgttatagctgttgtaggtttatggcctcttatagtgatgttcctcattaagcacccttttgatatcctggggtgaacaccattcttgtttcttccaacaccattggaagaaatcagaagatagcaatattatactggaattctaccttctcattaacattccggaggggacgttattctaggagatagttgcattctcagtataacctgaggggaacacaacttacaggcctgcagggttaactttgcaaacaccagcaggacatttattattaatcgtgccatggcaccattagcgaatacttttacagatgaataaacctccagagaaggttctccgatttcaagatgttacaaaggatccacagccaaattcccaagtcctctcagttccaagggctttcattactgtgggtctatatcagaaatcatttctaaaatagtgaaaatttaatattttaaaaatttggaacagatcctaaaactcaaacaggagatagaacaagctagcaactaagaaacctgataatgttagccatgcaatgttaaaaatatttcccaaaatataatttatggtaacttataaaagtcataggaaaacttgaagatgtgcttggcctttgttgataaggatgcaggtaaatgaccagaaattagtcaccatctgatttatttatttatttatttatttatttatttatttatttatctagagatagtctgactctgttgcccaagctggagtacagttgcacaatgttggctcactgcaacctcctcctcctgggttcaagtgatcctcccacctcagtcttctgagtagctgggacaggcaggtgccagcacatccagctaatttttgtaatttttgtagagacagggtttcgtcatgttgcccaagctggtcttgaactcctgagttcatgcaatctgccctgctcagcctcccaaagagctgggactataagtgtgagccactgcacctagccaccatctgtttttctaaaaaaatcatagaccagaaagtagtcctgagaccttcccttccagttcatctgtaatctctgtagagagatctcagatatctctatgagtactttttgtcaagagtagaactacacagctgggtgcagtggctcacgcctgtaatcccaacacttagggaggcagaggcaggcagatcacctgaggtcgggagttcgagaccagcctgaccaacatggagaaaccctgtctctactaaaaatacaaaattagccaggtgtggtggtgcacgcctgtaataccagctcctcaggaggctgagacaggggaattgcttgaacccaggaggcagaggttgtggtgagccgagatcacgccatcgcacttcagcctgggcaacaagagcgaatttccatctcaaaaaaaaaaagtaagagtagaactacaggcacagctccagtgatgtgttggtgcatcccaagatgtacaaggaatcaattgcatgctctataaaaatctattgctttatgcatctatgaaatatatttctgaacacaggcattgctacctctccaagaggtaaccaatttaacatggctcatgaatattaaagtttcctttattcccagatcacagtgcctcatattatgatttgacttttagactaaaatctactgcctaaattttataatccatctacgtaaataatctatattagattttatcaaaaagtgaacagaatattgtgtaactagaaaattccttttttcatctctaatgctcctggaaacactgtctaaatgtatgctgagtgacacctactaagctttcaagaccaagaataatctataggacccaaagaacaacaaatgtcagttagaaagttgttgaagcttctttgaacatcttgatgcttctactaattcaatataggattatatggaaagctaactcagctctttgatgtgccttttaagagaggatacacacactgtgggaagggctaagggtattaccatcagcatatcacatcaaaatggtataagtaaactagaaataatattgtactgcttctaattaaagttagtctctaccctaagagtgagttaatatctgctacggtaaattctgcaatgagaatgctaaaggctaccttagtgtagcaaatgaaccagttcaacaagagaaagtacttggattgattaattatgcctgccatgagcacaggaagaaagagcactggcgtgtgtgccaggtattccttctttttcagtggcatgtccccagggagcatggtgttagagaacttcaaactttactacactgactttggcagcaaaataaatataacagaagaaaggaatttctaaaaataaaataaaaaaatttgaaatagttctactgaatgaatggcatttccatgcttctgagtgcaacaggctgttcctggatcgttatccataaatgcttatgcagaagacaatactatggtccaactaggccataactagcaaaattcaatatgggtattgttgtttaatttttgattaataatgtgtatcatctttttacaatgagtattttttattgaacagtatatttaacacacttaaaaattatcctattaccagaaagatgtaaatgccttatcatattggattaatgttaacagactctactgccacctaaaacactgcactgcacttaaccataaatgtgccaaagtattttagggaaagttttccagatccttttattcttttccttttctcaaatactaaaatttattaatcatatatttcataggggagagcaaattaaagagataaaaaaaattaagatgagttgcacactgagctgactaccatggggagagattattagccccattttctagataaaaaaacaataagaagtgaaaacatcaggtcataaaccctgatccatatgatttaaaagttcaccctctttctactgcaccataccatagagctcagcagttttagttagaagtgtgacttcccccgaatgacttccaacagacaggccagttagacaatagaggggactaatagactggaatcacaagctctgatgtttgaaataaacagttacacaattgttttatgcttttctatgtacgtactctatgtaacccaggtgggcatctgcccagtagagtagatcattggtgtaatcaatggtgatgccattaggccactctaacttggtggagattatcacagacttgttggttccatccatgcctactctcccaatgtatgcgcggtgaccccagtctgcccagtagaggtacctgtcagggcaaacacaaagggtcagtccctgatgccaaaagaagtcagtagccaaaatacacaccttttctccatttagagaaatggagtctgcattctgtagagcagactgcattctgaattcttttctgcattcagaaaagaaagagagctaacagcaaataatctaaaaaagaaaaaggaaggggacaatgtacagaaaatgctcacaaataaacatagttaactggatttcagtggctttgacttcgagagtccagtaaagaaatcggttttctgaaaccacagttttctttgcatgcagccaaaatacaggacttgaaaagtgcaaaagtgtgtcagggaaaagaaaacagaagagctgatgatgatgatttgaagaagccatgcttctactcattacactaaacaatttaccaagtaggaaaagcagaagacaaaccccagcaagacattggccttgagatagttacatgaacagccttctcggtaacagaggcagaagaaggaggtgaaagaaaagcccaggattgcagggagacaatacccatattgagggtgaagggcaagtcctctgggattatcaaagcagaaggtgttgttggcatccacacagtgctgggccagcatgcggcggtgtccaccattgaggtcagagacaaagaggccatccaggcgggcatccaaccagtagagctttctaaaatggagagccaggagttaaccaatacagtcactttgtgaaatggtacatatttagccacccagtttcctacccaagctacctgagaatcacagacagttgttagaagtcacctttcttcaggcaaatgagggcaggggaaaacaggaagtttgtcttcctgcagtgaggcaacagagggtgcaagactgtgtgcaataattcccactttaaggtggtgtcatgtagaaaatacgggggacacacttcattcgacgggtctggttttactttcctcatgcagcataaggcaccctctccaggcagtgcaaaggcttagcagaacagggaagcagaggtgagtatcatgaattacagtttaaatggtggagtcaaggaaacacacttgtctaagtgtgtcattgaaactgcacagagaaactctgaattatgacattcttaagataaagattatgacatccttaggataaagagacatccctgcctctgtcagacaggctgtcaaaatgagtttctcaacctgagacacatttcacttaatcaaacctaagaagctttagaaacatattaggatctgttagaaactgctacctcaaggacatttctgttataaatgtatttttattcaataaaatttatttttcttataaggtaagtgttcttaacccaaggtctttacccagaatcagggaagccagctttggtgatctgtgtactttctaaaggggcccagggctttcaccagagtcttatagcatccataaccttccaaagggttaaatgcacctatagtgagaaggtcatttaggatttgataatcaattccaaccggaaggagaatgaaggagaatgatttcccttccaaaagacctgaatgcctctttgcaacaagtacgcgcttaaccattcatgctggatatctgaatagttaggacagtagcatcgcttcaggcttcagcaagaaagaatgagtatccatatatgtacaagtcttgccagttaattcacttgggtaaatgagtaaatcctgatgaatgagatggctacaatcttggattccatcatggtagacactaagaacagtgagaataatagtagctaattattgaacacttgttaaatgccaggcctcagaccagggactttttaaaacattatattatttcagatcacaacaggcttagaaggagttgctattattattcttgtcgtattagtattcctgttgctattaccattcaagtcctggcagactggctaccccatagggcactctactctgttgagcttactgctttcccattaatttctctttattccacagtcaaaagacatcctgtgaacagattcttctcaagaaaacatggagaagatattccgtctccactactggaaaaattaagataactgagagccaacagtatcttccaatgtgcgtaatggtggtttaaaaagttatatcaaatgcaagggctttggaaaccaaacaccctaatgctgacagcagaaatatttattaatattggagaaaaaagttgtttctaatttcagtgtagctagtatcttagaactgccccctaccaatgtaaatgtaactgggctccattctgcctttgtgttttcaggaacactgagcctggttgtgcaccctcctggactttcaagaaaagtttaccctaccctcacccagactttcttgcccatcttcctcacatgtatttaattctcttctgataaagaacacaccgagatagagaggaaatagctgaaatccaagagaaacgtcattctagcagtttctgagagagagggctgaatgacaatgtcttacagttcaaatattattttttctgcagtggaacaaaggatggtgacaagaacagtaccatgctcagttctgttcctggaaatcattaatcactatactttttgacatgtaggatacgtaaaacaggaattgatacatacaataggaatgcttagtcaacgtttcatttattatccagcaagcactcagcacctatgtcaggccagctactggtcagggagaactgggaagccaactgtccccacccattttaggatctttacccttaagggagtcaaatataaggatgtggggaagagccctctggaggtctgggctgactgcaacaagaatctttacagcatacatctttacagtgcctgcagattgatgtctattgaccacaaagccaattagtttatgctgccaagaatccgatagatttgatattcaatagagatgttaagaagtgtggttcatctggtagtttagttaaaatatcactggcctgccttaaagactgtcagtttccataagggcaatctcaaaacaagagtctcatgttagccattctccagttttcacgcccagcccatgctgggaatgactagtattggttgttttttttgttttgtttgttttgttttttttgagaaagggtctcactctgttactcaggctggagtgccatgcatgttctcagtccctgcaacctgcatctcctgggcttaagggatcctcctacctcagcctcatgagtagctgggactacagacgaacaccacctttcctggctaatttttttcattttccttagagacagatttcgccatgttgcccaggctggtcttgaacttctgggctcaagcgatcctctcacctcagcctcccaaagttctgagattacaggcgtgagccactgcccccggccaatgacaagtattgtaagcaaggctatgtacttcaggagagcaagggccatgtctgccttgttcccctcaaaacccctgctgcttgtcatcacgctgggcatgtaggagggactcaggaagtaacgactgaatgcaccaatgaatgcatgaatcgtcccttcatatcatctccagttaagtgaatggccagcaacagtgaactctcttcccttgcaattcctctttccataaaaatgatactataaatttttaaaataattagatattctgttctgaatctatcatttgaatatcagatacaaagcagaaaataaacctgcagaaacattaaatgtatctgcatattaacccaagttgaaaaattaatttcctatcaagatgaaaacatggttagaattttttaatttttaacttttaaaaagctcatcagtgttttcttacctggaaacccagtctacagccagactttctgcagctggtagtctgtggtttatgattgtctccttgtttgtcttattcagaaacattctctcaatgacttgcctctgtgtatcaatccaatacaatctcttctctactcggtcaaaatctaatgccacaacattgtccagtccttccaagatgagggagtaaaaatagccatctatagttaaatttctcaaatagtaacggttgctaaaaatgagatagggttcgatgttactgttttgccggcaggtctttccatctggttctcggaggtagcctggggcacacttacagatgtaggagcctattacattctcacacttctggctacagacaaaaggcatctctgtgcattcatcaatatcaacacaagtccgcttgtcagacatgagcttgtaaccaggacgacaggaacaatagaaactggttaaggtgtctgtgcagttgtgatcgcagccactgattgaagggtcatggcattcattaatgcctgtaggtaaaaagcagttcttagagatcctaaaatatcaacgaccaactcactataatggttcaaagtcaacatttctactaaacagtgccaattcttaatgaatcatgctaagacagacaacaaagacttccaaagactgtggattattgaaaagtcactatttttcaacttcctcaccaacttactccttcatcagtggtttcaacaactaatacaggagaaatgagaaagaagaggagaagaaaagagcctggccagtgtgctggtcaaacaggactcaggaaaaattttctaaatgctctgatttgtagcatgttccagtgtgactgttcacaccatggtcaagctcaggcttccagtgtgacatcactgaacatggaaccacaaagagatacacacatttgcctctcacgagatggcatgagctcaacactaggtgcaacacaacactacatgtccctctggctggtcctgtaacacatgggcaacctcacccaaaaatgatctacagagggaggacagcaagttcttattagttctctactcatcaaggagcaatagattaaaacttcatgcattgcaaaatccattatccaaatatcaggccaagctcttccactagttcactgtgcacccccaaacaattcgtttcccatctatgggctacagtcttattatctgcaaagagaacagggtacagaagatcactagtactccttccagttgtaagagtgaatgtttcataggtttggatgagacctactgagatcacttcgtcttcaagctaaaaattttaatttgaattatgtactattgaggatttaattcttatagttgaggtaaggcaaaattaattaaaatgcaatgggaatctatatgaattaggagtaaacataagaaagttccctatgatttttgtataaatgtataatatagcacatgtttttcttaatttattaaatggtttttgaaactttggtagaaatttatagaagtttttcttacaatagagcaaaagccagtttttggatgatttttaaatttttttctttttttttcttcaacttttaagttcaggggtacatgtgcgggatgtgcaagtttgttataataggtaaacacgtgccatggtggtttgctgcacagattttttaatattatgcatagataatctcttctccacatttccacagcagtttctgtctagcatttaattttaatgttatttcatataaatcttatctttcatataaggataaaaactacattacatacttctgggtcaattaggcaaatgctttcaatgagtactgacaatgaacaagtggaataaagaaaacaaaataaatgaaaggatatggtctctaaattgttattacagagacaatatcaacatacatgaaacaatggttacaaggattaaacaccacaaacaggacgaactgccaatattatggagttcaagatggtgctaagcaaacaatgcccatgctgtggattctcaactgctttacttgtggtggttggggtgagagagatattaaactctcccattcaattacctgaggacaaaaatgaagaacaggccaacgagttctagcagagggatgcttcaggcaaaaagtcattacaagaattcaaagagaatcaacctggttcccttcattcttgagtaccttatttggcaataatgttaaatgatggcctgaatatttgcccatcttctgttctctctaatgactatctaagcaaagaattggtccaaaaaaatgtgtgtccccatcttatataccaagaaactttggtaaccttttgctatatcaggaatagtgattttatggtaactttgtagttagaggacaggttggaaagtctaagtcgtgaagggttgagaatccatattcagtctcccctgtttccttttcccaaatcctctgttgtactcaccacagcctttctcatcgctgttgtccaaacagtcatctaggtggttgcagagtttcatcatctcgatgcagcgcccattgtcacacttgaactcgtgaggtggacacgtgggttctggggtgtggcacaggtgcatcagctcatcagatccgtctccacagtcattatcctcatcacagacgaaggttttactaatgcagcgcccgttctgacaggtaaactgattctgttggcaagtctggtataagcagcccctctcgtcgctatagtcaccacagtcattgtgccggtcacacctgtatcatgagatccagtaccactttcagagaggttggcaataaacctcaactattacccacttggggttttgcttccttctttatctacctaaatgccaggtcaaccatttcgacaagatcaccagtgtccttgatcccctttcccccatcatcttcgtctaccccactaatcgccaattctagaagaatccaatatttggcattccacacaacttcctcaggggctggctgctaccattagaaatgctaccattaaatgctaccatttaatagctatagataattagtaggtctatagctattaaaaataattgcattcattttttccttagttgataaactaattaaatacaacttttgtaattttggtatacatcagatctatgagacagcttatgaacagtggcactatctatgttcaacagataatgagatagccagtaggcactggcaatgtactgggtaatcacatgataaaagtgcccatacccaaatggaaactcatagggtgagtgctatatattataaataagattattgggtgtgtcctctaagaacacatatcttcccactggaataacgtttacattgtcagtcctgttccttccatctttcattacactcctgccatctatcatgagatgtgagtcttcatggtgatgtgaataaaggcaagctagtaggttagcatggcatactggcaaaggaagaaggcatgctgtagtactagaagctatctcgggacctaacatacacaggcatcattataacaatataatttcctgaagttctgtgagccaaactggcctttcttctccatattactccaagatcccataaaagttatgatgtctaaagggggtctcacatatgcatcaaggaatctttgataagagtgaacaaagctaatggttttgaacaatttatcatagaaagcataggagcggcacatagagcattacaaaatgtgaaggcaacaacggtgaatgtggtcagttttacaactgacctataaccaggcctgctaaccagcactgccatccataaacccagggccttgtcaacatgatttacagcaaaatgtgtgcatgtaattgtgaagaaagctgtggtcaaggcagactggctcagcttcatttggtctcccgggagctatttaactcatttccaaatggtttgaaaacaccaatgttttcctttgtctaatttagatccaatgcaggaggaaaaacaagtcatcaagcaaatcaccaagctttcagacactattgcaagtcagtattccagctcatcaccaaattgtcacccctcagtcttatcatccatgtttttcagcagcatcagtagtgagccaagaaaaaaagaaggtcaataggaaaaatgatctcctgtcccactgtaccaaatggggagcacactttctgccaagcaagcaaggagatgcacactaacagcacacctagtagaggctactccagacacagattttggacttacttagaagctgatagctcaggttttcaaacaaacagtatttttttttctcttctactatagcccttttcaaggaaattcagaaagctcaaggaaaaaaagaaagagagagagaaagggagggaaagtgaaggaaggaacaatggacgaacaaagaaagggagagaggaaatgttactgtgctgtgagatcatagtaatgataaaggaagaacccagaaagctcagaatgggaggaataaaggagataacttggagtctgatcaaaatcaacacctgctaccattcttgtgcctagagtctaagcctaggtattcagaatatatttacatctaagactaatgctattagctatttaccaaattcagaaaaactatagaagtgcaacacaatagaactcttgagcagtagggagaaaatatagacaaagatttatccactttaggtgcaaaaaataaaaatctacactttacattcatattacttaaatacaaacaaagcatattctactgcagcttcactacaaaagaagacagctccacctcttgaatgtctttgcattgtcagttcacaaactaccacctctcagcaatgtccactcatcagaggatgaatcacccacagagtgtattttcctgatagcatttatctactttttaaattactgctgagtccctgctccttcacctcctccttcttcctcaggaccaccacaataaacacacaatcgtacaccacactggactccaacggtacattagcgcctgttgatgagctgcctgcccctccagtcaatggcccctgtgactctgcttctctgatcttgtgcctacttagtatatctttcccactgtcttccttcgcatgctgtaaggtggccattcctgatgctctcaatgtgcctgtgtgtgtcccttaacagtccttggcacaagcaatatctcttcacggctccagttgtgcccaaatacctaagacatactttcacctcaggaagtcctactatgtcaaactcaccttccaccttgagcaagcgcctttctggactcccctacttttgctaatgctcgtactattttcctagtcaatcaggattgaaacttacaaattgttcttctccatttccttccataatccaagtatttgttaagtgggatgatgagaagttgggatgttaagaatgtatataaactgtttgaagaggcccatttggagaaagaggtaagaagtcaaacaatggaacattgcaggagaggtcccccaaaccagcaggctgtgagccgaatctgtttgatccacacagtgttttaagaattttaaaatttgtttccagcatttaaaatcagagtatttcaaatgaaaatccagatttccaacttctgtcaaaaagagagcatcagaaagtctggccttccagcccttctgcatgatattgatcaatgtctgcatccttagttggagacattgtctcagttcactccacctgcctctacttgactctgagcctaagagccaagctctatttatcatcatgcttgtgctgttatttttcttgtagtagagagaagagagtgaaacagttcttgtaataccaatgcctctactccaagtggaaaactaagcgggtcaccagcttcaagaaagaattcttatctcaagccctatccattcatctccctggccctctgtgcaaggccagattctgtctttcacaggccctaggcatttttgccttcttgggttccttcctccataaaaatattaaaaattatatttaattttaaattgttaatatggtattatgtattaataattcaagtaacttcttttcattttaatgcaatcatattggtataaagccagatatattaatattatatattaaaatactttctttgatgtaaaagttttttttccctttgatttggaaaggaatccaaacattttcataagccactaaaagcatcatgggccctgggcactgtggccacggggtgcctgataggtaagtgagcccagcccccatggacatttgaggcatgctgggtaacttctgaatcctcaattcacctgaatatctttgggatacacagtccgtaaccacaggtgaattcattttcagagcaagttctcctggtgcaattctgattctcatcgtagccgtcagtacaatccacatcgccatcacagacccaagactggggaatgcacctcctgtccggaggtctgtcatttacacagagaaactcggaatccgagcagttttgattctctgaaaccaaagcacgcaagaatcagaaagcatgagagctcagtgcagcagttaattctctttgctttaatgttacttaccattctaagtatgaaaggaaatgggaggaaaacacgtagacaaattacactgctattataataatagatcataataaaaatacctccaaagattccattttaattgctttggaccctggctttttcaaagaaatcaatacaataaaatgtctcatttatttttccataaaatacattagaatggtcatactttttcccttagggcttcagaaaaccactaccattttgttaactggataccgaatgccttatattttggtaactttttttagtttacaaagtataatcacacaagcacaatgtgaaataggtatttttacaccatttgtatagatgagaaaactgaagctcaaagatggttaactggatgtctcaaagtcatagaactaggtgaagagctggggcttcaaacctaggtctttctcctccaaatttagtgcttttccaactacattatagctaccaccccaagcaatattggggtggagaggaaaggcatatgctaacagagttgtcagaaaccatgatgctatgaggaaagaggtgagatgctgacatcaaatcattagtgtccacaaaataaaagaacaggggttttatccagactcattgcaggtgaataggaaacaaaagaaagaagatgatgttggtaaagacaggtgagagaaatgcatacaccacaatccatgtatgtgtagctgaaaaccacccatgtcagtggatagggtggatagggtaaatgtggagttgtgacccaccaccaaagtcacaacacaggagggtgccatcagatgcaagcagcagggagccattgagtctattgccctaccatagaaagacattattctaacaccgattagattaattcttgaactagctaagatttccataccctgttggtaatgaaaatgatgttccattatctactcaagaggcataacacccctccctccatgccgctttaaggtgacaaaggaaaccagagacagttcattgttatactgtgaaggttgctattaagagtggccaaccactgggtgcagtggctcatgcttgtaatcccagcactttgggaggccaaggcaagaggactgcttgagcccagtagtttgagattagcctagccaatatagtgagacttcgtctctacaaaaaaaaaagtataaaaaatcagccaggcatggtggtgggcgtatggtcccaactacttgggaggctgaagtgggaggatcgcttgagcctggaaggtggaggctgcactgagccatgataccgccactgcactccagcctgggcaacagagtaagaccttgtcaaaaaaaaaaaaaaagaaagaaagaaaagaaaaaagaaaaggagacaaccaagtatttgtgggttttttttttcccctagaaatgtaggacattatgtccattagccaaatgtaagagaaagaaagtaaacataaagtcatttttcatcactctgaagcatttaagtggatgatatcaaacactcccagcatggagaaacaaaggtaacattctatcagtgtccattcaattacagagaaatctgcaatcatactctccaaacacagaaaaacaactctactgtgtttccctggaatgtgactctgcagaggaattaattggcttcacttacgacactggtgccttttatcctcgtcactcatatccccacagtcattatcaccgtcacagatccattcgcttgggatgcacctcccaccatcacacttgaactcatcagctaggcatgttcgctcagagtgacctgaaaagatcaatagcattctcagtgaaaaaaagtggtttacagtccaggaatctggagacaagctggttgtagcatgggttgtctagaaaacctgaaacagagcattatttaattatatacatctagggtagtcctccaataagactagtaccagcgaccaacagtttgaggtaaaagtagtcaactgacagtgcaaagccctaattatctttggtgactaaaatgagatacaatattcccttatgtgtatggtagagaaagaacacttcttttcccaggaaagatatgaattacctactatttcacatgtttctattttaaaatctacttttcatccaaaaccattttgttttgtgcaaagtctcccctcgcctgcactccccatgcccgcttccttgctccctttccttctttccataacacttagcaccacctttcaacatactagacaatttactgattggttgcctgtctcccctctttagaatattagctccatgtgggtagggattgttgtcttattcactgacacagcccaaaagttcctagaacaccactgttcaataaatactgaattaaaataagtcactcttctacttcaaattagccatcactgattcagatgctctaaccctaaccccacatgttcctatttaactaatgaaggtgtcataggctcccaaacccaggggaccctggaattagcctaaggcaagagaaagtatagttgcaactgataaagacacagcctatatcataacagtaacaagaaacaggctctttcagaagctgctatgaaaagtgtgtacattgatccagacttttttttttttttttttttttggagacagagtctcactctgtggccaggctggagtgcagtggtgcgatctcggctcactgcaacctccgcctcccaggttcaagtgattctcctgcctgagtagctgggattacaggcgtgtgccaccgcgcccggctaattcttgtgtttttagtagagacaggtttcaccatgttggccaggatggtctcgatctcttgaccttgtgatccgcctgccttggcctcccaaagcgctaggattacaggcgtgagccaccgcgcctggcctgatccagattttttgaagagacatatctcctttgatacagcagcaccatttctggacatctagaccataaggatctttccacatgtgcacaaaggatgttcaccctgacactgtttttcatagtgaaaaaatggaaacaacctaaatgtccaaccactaggaaaaggataaaaatacatggaccattcgcattttaaaatattctttggcagtgtacaggaatgaggctggtctgtatttgctgacatgatgttaagcttaaaaaataaaagctaattgcagaaaatatgtatagtaagactccatctgtttttttaaaatctatatatcaagatatataaaagtaaagtaagatatataaaagataaaagtaagtcaaattcacactcaaccttttaatagtgattacctttgaggagtgaggggattggagaaggatgaaaaaatgtaaattttacttttttgtacatcgtattatttctttaaaatatatttctgaatattattactttactacaatgaggatatattcatatatagattatgtgcttatttttatttaaatatatcaggtcattggtactcactgctattactatggcttttgttaccatagagaagtttaaaaactcatattaattattcatatatttgaaccaataattcatacatttgaaacaatctctaagactattctactcatccagcagttattagttatttcctttacaggtcctcaaaactctatgtgccctttgctttctataaaactttcagtgttggggaaaaagaacttagtgaagcactccaaataccactcttcaacacagaatttaaacctgagagaaaactggaattgaaaatagtttgacttcagctataaaactatactaatgatcctaagaaaatatcctgaaaataaaatgttttaaatacgatgttaatatttactgcaatgatatatactatagaggaataaaataaaagcaacctaatgcttaataatagaggcagttaatttgatgatactataaccactcaatggaatattatagtcattaaaaggcagtatgaagacaaggacgagcaaactttttaactagatagtaaatattttaggcttacaggccctatggtctctgttgcacctacaggacgtggccatagtagagggacagcagccatatgtggctgcatttgagtaaaatgctatctataaagacaggcaactggccacagccatagttttctgactcctatatagcaatatgatttattgacaggttttttaaagcaatgtagaagattgtatttttatatttttacaattatgtaaaaaatgtgcatggatatagattagaatttgtgaaggcaaatagcagcctccaaatgtaaacagggcataactgtccccaggaatacaaccaaaggctcctgcaacttcttgggcctcttgtgctcataaactggcacagagagagaacaggaagaggatgcatgctcctaatatactccttccccatgtatatgactccaatcacttttaggtcctctgacagctttctgggccagcactcaaccaaattcagaaacttcaattgagagccaactaaaattaagttctaccagctaagcactgtattaggtgcatcaccaatataatttcattttatcagcatcaatcagcagcttccgtatcctgatcagctccccacacagtgctctccactaacaggtcttaatgaatatccgctgagcggtgtcagcattccagatgaaagctgggacaggaagtccaagcattcagcagccatgaccctggtctgtatttgaagcagttggaagagactgaagttgtctagctgcatcgtgatgtttttcatgcttgcttactctcttaccacaagaggcaggttcatcagaggcatcaaaacaatctgtttcttgatcacaataccaatgttgaggaatacagcgcccagatgcgcattggaactcactgctgctgcacgtgtgagtggctgcaggagggaaagaagataaaacccatgagcaaaacacaagcatgttcccatcagtcttaacaatctgcctctatctctgagctagataatagttaccaaaaaaggaagactgagcctggaaaatggatgcttgtgtaagctttctgtggggaggaagaagtatgggagacagaaggaagtcaatcctgccccaattccccaatttgtttttctagattccagaaatcaaaaaaaaaaaattgtatttgttagaaataccaaagaactatctttgtgataaatgaaatcacaaattataagtcttggttttattttttctactataatgtaagattaaataaattccattgcaatgataattaaaagcaaaacaataatgtgatcatatctaagctcgctccacacacaaccttttagctatgttagataataactctagaaagttggcaaagttatcttcgtattcatccttggaataccagacttttagttgagtaagtgggaaactctgcctatgtttgaacattgactcttttctccagtaattttaggtagctctggttatatgcattttccaaattgttatgtgggtgcacatctaattaaagtcttgtaattcttctggtctataaggccgttttgctttggcccctgatatctgatgatttgccaggggagaactgacaatggaagcagaggtccctgaaaagtcagcaataattcctatctgtctagccctatctggtggctgcaacctgaattctgcttccttgtgctgctgttattacaacagattcctcttcctgtgctgtaccctaatttggtgacaaataattatgatgccctttgatttccttgggaggggccagtgacaagagtttaactacatatacacagaacagggaagtccaatcactaaatccttaaattatgtatctatttacactaatagtctcaaagttatcaaacttaagaaaggccttttaatttgagctataaatacaggaaattgtttgaatgaaccaaattgctaaatacgaaatagagatttctgaaattccaacgtatctaggggatataaagatactttcagttactggtcaggcacggtggctcatacttgtaatcccagcactttgggaggctgagatgggtggatcgcttgagcccaagagttccagaccagcctgggtaacacagagaaaccccatatctacaaaaaatacaaaaattagctgggcatggtgtcacatgcacgtaatcccagctactcaggaggctgagatgggaggatggcttgagcacaggaggcagaggctgcggtgagctgtgatcacaccactacactacagcccaggtgacagagtgagactgtctgaaaaaaaaataattttcagttactgatggccactataataatattaagagtaaattataagggcttaacgggcaaattctgcctaagtacatgaaggcaaaaggctttcaacactgggagaaatggctctccaatagtagcagatctctggaagaaatattcagggtctgggaattctagccagggaacagagagaaagagtttctcatacccctgcaatcacatatgaaagcaactgcctaccacctctacttagaaggtcaatgtgaaatgacaattgaaatcagcccgaatacccacgcttcatatctttgtattagctcacaacatgcatctctggaacgatagaaagaaagcagttttatcttactcactgcaataagtagggttttcatcactgttatctccacagtcattgtctccgtcacacaaataaacgcgaggaatacaaatatttgaattatgacattttgtgtatccagactggcaagtgcgatcagcttgaaaaagacaaccagataaatattaggaatatatccaccaaatatgtattatgaacagtatccgtgctaacacatctattgtggaactcaaaccactggaagggcggcattttcaaagccatcagaaaggcaggatccatgatacttatgttacctatagattctgtagtaaaaaaacatatttccagctgatactggggagaagggagaggagacactggtttgtaacttaaatcatctgttttcattaattaatagcatcaacaagagttccaactcttggtaaaataaactatggcatttccacacaatggagtaatatgtagctattaaaggaataaagaagatttctatatactgataagtaatgacagtataatcttcaggatatattgttaatagtaagaaagcaagattcaaaacagtaggctaacttttgtgtaagaaaaaggacgatataagtgtatgtgtgtgtgtgtagcaagagagagatgcttatattaaaaacaataacaacaaagaaaagataaactaacaaaaattgtcatctctctggatagactgagaagagcacagaggaagcagaaaggagaggaagaaatgaaggacttctataaatgcacctcgtcatgtagttttaactttggaactatgtatgctattttgtacaaataaaatcaataaaataaaataaaatttggaaacagcaatagataaagctaactatatatcaggttgatagcataaccctgcagaaaaaaaaattccaaatatctttaaagtcatacctttgactgcatatctctagtgggacataatctaaaaagcaagaagaatctcgcacttagtagacttattgttaatagtattctttgagtggttataataatgttgaaattattataggcattttgaaattactatataataaaacaactaaatgtcaagagaaactatgattttaagcataagaagagatgtcattataaaatctaaaatgtaaacaacctgtaatcttaaatttcaatgggaaatatcaataaaaattttttctggccgggtgcagtggctcacgcctgtaatcccagcactttgggaggccaaggtgggcggatcatgaggtcaggagatcgagaccatcctggctaacatggtgaaacctcgtctctactaaaaaatacaaaaaattagccaggcatggtggcgggtgcctgtagtcccagctacccgggaggctgaggcaggagaatggcgtgaacccgggaggcagagcttgcagtgagctgagatcgcgtcactgcactccagcctgggcgatagagcaagactccatctcaaaaaaataaaaaaattttttttccttaaaaactgtatttcctagctctgaccattgaaaaggactagaagcaatgaaagctaagtaggaatgagcaactcaaccctgtgataatttctaagtaccacaaagggaatgaggtctccttggataagtggctaattccaggactgggacaggaaatataagacaagcttgagctataagaagatggattggggtcatgccaaagaacagaaaattcaagttaaggactcccattggcctaagtttggacaactgggcaccaagaaaaaacagttgacagcactgtattaaaactcatcaaatacatgaagatcaaagagttcaatataatactaaactaaactaaactaaacaaaaagttaattctcctttgtcaccaactcattactctgaaaattgacaagcaaaaggtatttatcctgtagattctaattaccaacaaaagctggtaagggaaatgtcttctttatcaaacttcagctaataaatgcggcaggaacactagaattctaaagagcccattcataactcttaaagaaataatgggtttacggaacaaccaccgatggatgctaaaaccactgggtgaaaggatgatgggagcttcataagagatgattcaggctgacaccagaatccacttaaagtggggcaacaaaacatcatgtgcctcataaggtgatgcaacaggaaaggcacagctccacctctgaaatactcttacccaaagaattgcacctgttatgatcaaaactctaggtctacataccagttcataggaaataagagggataagataaattaaatggatcaattatgcaattagtcaagtccagaatgtgagatattctacaggacaaatcacctaatctttctaatgaatcaatgacattaaaaagtgggaagtgttgtggcataaaagagattgaagaattataacaatcaaaatcagttgtagatctcatctgaaccctaacttgaacagagaacagtaaaaatacattttggggataagtgacaaaatttgaacatggactaggtactcagggatatttagtaagcacttttgattttgccaggcattataatggcatggtagttattttccaaaatgttatcagtgaagtgcatgactaggagtcactttaaaatactagaaaaaaggagagaaaaatgaaacaagattggtatttgttgatacttgctaccgcgcctagccaaaaatttacgttttagataaatacttagggtttttatttttggaaagccttttttttatataataatttcatctcctgtgatccaagacttcagacccaaaatcacaataagcacttaagataaacttacggcaatttttctcatctgaagtgttattatcatggcagttgtctacaccattgcagataaactcacgaggtatgcaccttctgttattgcacataaactccgtggtggcattgcagtccctgaacaggcaccctgcctcatcactgccatcaccacagtcattgtagtaatcacagcggtaagagtattggacacatcgcccattggcacaggtgaaggctgtcggtgagcaggtgtgaagtgctaagaacaggaaaaacatgagaacaaaccctcttgattaaaacattatcctaatttttaaaaagatacaattaaataaaagagacactttgaatttaccttccaaggcaaaaaacgctgcaaaatggactgcatgcaaagtgagataacacttttaattagttagattaagcaaaatatgttgtatacatttttaaaattgttttaggcacaaatcaagtaatttaagcacaaatcaaagtcattctgtttctctataatctcaatttatctcaatcacaaaaagcatgcaattatagtttatttcaggaaaataaaaactcctagcccctatcacagtctgctaggaaaaggtaaccaacctcagaactccctgagaaagtccactgtgttttattcactctattcagatggaagctgaggattggaagttattttcataaaatttttgaaataatgacctttgtgctacgaaaattggtaaaatgatacgtttccttagtcccaagctaagctagacttagcttgcaccatgcctcatgctaagggatttttacatattgtttctcttactcctcgcaagaaccctagtagtagctccattttacagatgagatgtctgaggcttgagatattaagtaactttcccaggtctatacagattacaaatgcgatcaccaggatgatgattgtgcttgtgctcttaaccactacagaggtgatttaacagaaacagtctggattatcagaggaaacatttttcagctctaccaggatgcctaggcacacatttcaaacacattcacacatagcaggattccataccaaacacttgacatcaagatgccattagctcctaccaaaagcgccaagagtccaactcaccacagacactttccatctcatcactgccatccccacagtcgttgtcattatcacacttccactcttccgagatgcagcgcccattggagcaggtgaaggaagatgcaccacatcgttcaccattgtccacaatgcagtgcttcctgttgttggccaaataccagttgccctcatgtggacactggcactcggcaccatttggacctgaagaaagataatcccagaagaagtaaaagatggatgcagccaccgttcacattgacccctccacaatagcacttgcaacagcttctacattaaatgctccctaagaagcgccatggaagttctgcccattaaccttttaactatattctgagtcacttttccatcaagaagagcaatcaccaatttctaataaatgtgccgattccttctaaacaacaggaaatatcaacgactcttctcagcaaaatttgcaaagcaacaacatcaaaaggcacatcttcccgtgaatttgttgttctttataaaatgcacaatgaagcacatatgatcccacccgcaaatatcaccagaaatatttcaaactataaataatacctcttaagcagaaaatgtaaatccttttataaggaaggccagctcattgacagaattcttagtcaagacatgaagtagggcagccaaggccttcatctttctttctaactccatcaagcttgtatttaaaatgccttcataggctgagtgctgtggctcacgcctgtaatcccagcattttgggaggccgaggtgggcaatctcttgaggccaagagtttgaaactagcctggccaacatggtgaagccccgtctctactaaaaatacaaaaattagctggacacgtcgtgtgcctgtagtcccagctactagggaggctgaagcaggagaatggcatgaacccaggaggtggaggttgcagtgagctgagatcccgccactgcactccagcctgggcgacagagtgagactccgtctcaaaaataaaataaaagaaaatgctttcataaaagggctccatatagattagaaaagaagcctgccaagtcttcctctcaaaatatagccccaggtctgtttcataaattaccctgacatcaaggagaatttgaattttttctcctgtgagaacttcagctttccttaccaattggtattgtgatcattattctccatgttctaattttcatggtcagtgccttacctggtgcacagatatggctgcagcccccattaaactgttcacaaggattgttacactgttgtttctggttcttcacaacagtgttgattcccctgggctgggagagcaaatttgtggtcattgcaatctgacctgacccgtcatatttgttagctcggtaaattctttgtgtgtacaagtcagtccagtaaatatactggccatagagagtcaagccaaaagcatgaacggctgcattgacaatgacttcacgatccacgcccgtcagagtgctgcgttcaatcctctgcctaaaatgaagcaaaaaaaaatttagaagttgaaatctcaagtgagttaagttttcaactggcagcccaatgcatgcgcctcatcattgtttacacaagctgcaaactttcttttcaaatggggcatatggcagctggaaatgtttcttctggtgatgggaggtcttgtttgcttatcaaacaatagcctatataaaatcattgacttccaaatatgaatagtaatcctacaaaaggaatcaggttgatattagaaacaggaaaacatgaaataatccatgtaatgcatggaactcagtgttaagcacatagcagactctcaataaaacaataacttttccatcccacttccttagtgactttttcaatttgatgtttattgagtaccttgaggtgtttacctagaataatccaagcttagactcaaagcatcactgctttgtttcaaataggagaataaagaaaagatcaggaggttaggtcttggcatcaaaagactaaaattccaaagaaatatgcaagaaaaattaagattcccgatatgtagacaccagccataataaacaaaatcatttcatcccttcaactattccattaggatgactggaatgtgagacatatggggggtacttggagaagttacatacaaaattagagttgacaaaaggaaaatattaagaaatgcgctgaggagaagcttgccagagaagaaagggtctatttgaaaagatgacaaaaagtcaaagactgaagaaaagaattttctttttttttttttaagaaaagaattttctaaaagacattgaatgctaaagcccagaaaaaaacataatatcaattggcatttaaaagtcattcagattttatagcagttacctagggcctgcagaatgtaagttgagtaatttcatttgtaattctaaattgagaaaatacatttataattatagctgaaattatagatatatttagcaatgcatctttagatgtcttttagttcataattattcaatgcatgatatagataaattttcacagtatgttcaccaagttccaatataaacatagttcctaaaactgtgattctatattctggcaatgtctatctggcatgctatattttcatcacatgatgcaaatccctcttctttggaaatggaagaaaaacctcttcttaacacccacatgagtaaccagagacacctacagactagcatccacccagtagagaaggtcctcttcatagtccagagtcagcccactgggcatgaccagactgctgttcacaatgggtacgcggaagtttcctcccaatgtggctctctcgattttggcatgtgtatcccagtcagcccagtacaggtacctagtcatacaaaaggagtcaataattaattcacagggaacctcatagtcctttaaaaaaaaaaaaaaggacaatattctttaattgcaaattgccagtaacatggcaaaagaaacttcatttctacttacacaacttgtccaaaggagatctagtaagtcagggtgttgacttcctagtatgttgccaacctttctgccatcaaagggagctatgcgctgcaccctccttcccacgtaaaatcactcaatatgctttcatttttgaatctgtagccatagttttataagcccataacacattggctatctatgaacataatttcaggccccattttttccagaaataagcagacagaaatataacaaggaagatgatggcatacccttggcagggatctaacacaattgctcttggttttggaacgcgggctatcacagtgcggttagacccatcttcagccatggaattaatcatctggttgaggtagtcactgtaataaattcttctagtaatccagtcaaaggcaatgccatcagcagtccctatacctggacacatacaggcagacacacacacaagcacacacaaagacattagagtctcatatgcattagaaacactcagtcatccatgtgtgttgaccccattgtgtctacttgcaggacaagcagcacctggagtgcacttacctgaagcaatgacagttggagtatggatccctgaagacagggtggcataggaaatctgtccaactccagaggctaaattttgtgtgaagtagattctatcacttacactgtcatagtctagagacatgacagttctttccacatttattgtttggaaaggtgggctatggttttcagggtccaagtgtaagcttctcaaggaattagacaaggcaaagatgaggaaattttctgttgaaatggcacaattcttgccatcactttgcagggtcccaaaggcacagtcacattttggggtgtgcaatccaggcagagcaaagcagagatgagagcacccaccattgttttccaagcaagggttgttgttgacctctgctggtgaccggggctggacttgcttgtcaaagatggtcacatctcttagccagttgatattgtctcttatcactgtgggtggctctgtgttctctggttccttgctggcttggaagatctttttcaaattcctatctacccatatgatagaattttcaaaaacagtgatgccataaggagttgggtaacgactgccataacgaatcacttcagagttctctccattgatacgaatccttgcaattatatctaaagaatcatcaacccaataaacgtagccatcacttcggtccactgccaagccccgtggtgtgacaatgccctctgacacaagcactgttcgattggtacagtcaaggaaagaacgctcaatctttggtctctgcccatagtcagcccagaagaggtatctgttcttgggatctacaacaatatgcctaggcatgtccactgtgactttaagaagaacacggcggtaagtagtattgatccgcagaacttctatcagtgtttcagaaacaaaggcattggtgaaataaagatttcctatgggaaaaatgaaagtgcatgctgatcaatggagaaccaagaagaaaaaaagggagaactttacaaattcagaacaaaatatataaggttgaagtctgggtcactatatgttgtcttttccaagatgatagtgtcccagtctaggcttagaaaaataagttcttactcctaggaattatagagattgtgtcttcaaatttagagagaaagtgcctatcttcagcttctaaagtagattagaattcatagcaacatcataacccactttctactgaaaggtatattttccagaatgtccctccttttctatctgaagctctaaatgcttaatacctacttgaaacactctaaatatacattttcatagcacaacttccatcccaatgtgataaaagtagcaaagagggagcaccagcagcatctcaggttgttattaatgttatcaaatggtctttgaacttaaggttaacatgaagtttttccttagtctttctaactaatgtaggtgttttcatcccatggaccttctaaaagtgaccaaaagtccatttccctttgggccttatgtacatgctagaataaaaagataactttatgaagatagtataataagtagagaatgaccacaaattattgatttcatgtagttgaaagtctgttgttgaactatcaatgctactaccaagacacacatattttgttcctatatctgattcaaaccacctctagagaaatcaggccaatgtgaaatatgttactgatacattttttcattacctaactctacttgctatgtatgcatttgctcatttccaatcctttaatccagggttggcaaactttttctgtaaagggccacataataaatattttaggctttgcagagcatatggtttcacaagtactcaacactgccactgtaacatgaaagcagccatagacaatacacaaataaatgggcatagctgtgttacaataaaactttatttacaaaaacaggcaacaggctgcatttgacgcacgggccatagtttgctgactactgctttatctataccctcagaaatagtaatttctattcaggaacgggagttaggaacccaattaaagctttatttaaccatacttccatatttactttttgcaataaactcttattatagtacttagattttcataatacatgcttatatttcctttttttaaatttttttttaattcgagacagagtctcagtctgtcacccaggcttgatggcagtggcttaatctcggcccactgcaacctccacctcccggcttcaagagattctcctgcctcaggctcctgagtagctgggattacaggcgtacgccaccatgcctggttaatttttgtgtttttagtagagatggggtttcaccatgttggtcaggctggtctcaaactcttgacctcaggtgatccgcctgcctcagcctcctaaagtgctgggattacaggcatgagccactgcgccctgcctacatgctaatatttctaagtgatgcctactcaccaagcttgattcaatgatactgattttatgtagaattggattatattccaaaacatataataccactaattatgagtggtatttttactcagatgagtgataaaaatgaggggttattcaagcttatgtgcatgaataaatacaactaagttaatataatactggaccaggcatttaaaaaaattactaataaaatatctcatgatctaagggatttttatatatgaataaaaggaagcaattaagaatttggcaactaaaattgctcagcttcaaagcaaatgaatgctgttccatagtttatatttttatatctctttctcttgaaaatttagaaaatttctaatgcagaaatcaggtgcaaatctaagtgtaaaaaaaacaaatccacataatttaatattttagccacttttgtctccagattatgttaataacagaagaaaatgataaggattaatttgttataaatctgtaaactgaaacaccgtatcatttatcaaatagacacgtagcttaatctagattcaatgtatcttaaatggtcttaataattgtctagaaaaacaaacctgtagcacatggagttaggctaaactttctagcataaaataagatgacagagatgcaaacatattaaaatcaccatatagcttacatacctgctacccaatccactgcaataccccggactccattttctcctattccatgtgtcacaatgttcatcagagaagatccatctggtttaattctacggatcgcattatcagatgccactgagctgctaaaatcacaccaataaataaagccagaggacacatccacatccacatgcagtgcgtttcgtcctggaagttaagaaaagatcattaaaaaatgctgtcactgaaattagaacttttaaatgtctgcccttcctctcaaaccctcattcccaaccccctgctctgagcatctccccattacaaaatgaaacccttttttcccagttgcagtgagcagacccacatcttggtttctactctttcccacaataaggagctctggctcccgggagaaatgttgattataggtttaggcagggaaggtacgaagtgagtgtgaaacatcttattgtaccaagaaacaaggcatacacagaaatatacaggtcgccacttgaagaggttctccctggccaaaatggatccactaaaacatcaaaagaaggattacagtaattgactgtaacacactgaatttaaaaaataaaaatttgagcccataataataataaattatttaaaaagtaaaccggggagacacgaagagctttcctttatagaagaatattatctaacaaatgtaaagggaatgctaaaataagaaaatcaccattttgcaatcctcgattaaataatcatttcaaacaaggatcatccatggctgccaaaaccaatgggtaaaaggtgcttgggagccaagacattcacagggcctaagtgtgattgcatagattccaccaaaattaagaaggaaaaaaaatacagctttaaaaagcagcagtgtagcagtgaccaccttaaccaagtgatcaaactcaaatgccactaagagcagggcaagctgacattatgttcttcctaataagattctgtatcaactaacacagcataacctataaagtattattgctaaatgtatttaaccttgatctaatcaagcaattagacctaacttccatttcatgagaactgcagggtaaaaaatgaaagacagactaaatattcagacaaatcctcagtgtgggattctcaaagacaacaggtctgcctctttaaaacatcaatgtcatagcaaaaagctagaggcaactactccaaactggaagaaactaatgagatattcccagtgcagtgcatgaatcttgattagatcttggatggaacaaaacagctatatataaaatattgtgaggccaactggagaaatatgattatgaatatttcataatgccctttgaaactgtatgctaacatatgtaggggtaaagtggcatggtattaaaatttatttttaaaaggttcataaaaaatgaatgtgaatgcatatgcatgtacacacacacacatacaaattgagagctcaaatgtgaagaaatgttaacaactgttaaatcttggtaaagggtataaggatatttcctaaatctttcaacgtttctgtgtttgaacatttttttaatgaaaagctgggagaaaaaaactattgaatttgtcatatctgtacaagatgataacttagatccataactttttagatatggaaaaacaaagatgagtcatgggtccacgtgaacatgaccatcaggcaggaggacgtgtgggactggaagctctctgattcccttctccaggtgcatttctgtattttctgaccatctctacaaccccttcattgacttcatccttttttccttcctttctaccctctatttctctctttagcctgtgacattctcctagcgatgttagaaaactcttagttcctcttgtgctaaggtatacctaaaaaccttggctcatctaggaagcaagtgatcgtttcatacattcacagtatgtaagcacaaagtgctgcaaaaatatgattactaaagagggactgacactgtgaactcttttgcttcaattcaccaaatatatattaataaatcatatttgtggactatttcattaccatattaaatagtagtataccttctaccataaatctccattaataatcagaaatagggcacagttctttggaacaccaactctgtagtacttcttgcaaacccatcctacattctatattgctctgggcctgtggttcttagcgtgatccatgggccagcaccgtcagcatgccctgggagcttattaggagtgcagattctctggccctaccctagactacaaaatcagaaaaatctggggacgaggtctggagctgtgttggcgtgagccctccaggtgattctgagacacactaaagtttgaaaaacactttaggctgtgccagttgatttaaagggaaaggaaagcttcattatgcactgaatccacacatgaagaaatgttttcatggcaccagggatttcaacctggtgccagatgaagtcaaatcttacttatattggagttggcataccttggcctgccaccggcaccatggtttctgaatgatctgacaattccaagctaaagcctctgattgcagacagcattgaaacaacaatgaaagagttatatggagagcaggaccgattatcaggattgagtttaaatccagtggcacaggcgcaggaaaacaatcctcctggtacaggcaggcaaatctgctgacaggcattcatgttgttgctacagccatttgaggattcggcggcatctaaatgaaaacaaaatccatttgtaacttttgatcctagctactcgccaccccatctcaaatttctttaattgggtcaccaaataatttattctaaaaattaataaccaacatatagtagctgagttagcaatctaaaaacaacatcggagagactagagcttatacaataacacctaaaggtatgaaaccagtaacccaactattgtataatagttagagaatggggcttcacttgttttcttctacaaatcatgcgaggattagggaggtcagtatataaatctgctcataatttgcctatgaactggcacttaaaataatatgttcagttacatgatcaataatgtgattttttttaaatatatgaaataagatttaaagaatagtcctggaattaatggcattcccagtgacttggaagaaactggagactattattcaaagtgaagtaactcaggaatggaaaaccaaacatcgcatgttctcactggtatgtgggagctaagctatgaggacacaaaggcctaagaatgatacaatggactttggggacttgggggaagggtgggaggggggcgagggataaaagactacaaatagggtgcagtgtatattgctcaggtgatgggtgcaccaaaatctcacaaatcaccactaaagaacttactcatgtaaccaaacaccacctgtaccccaaaaacctatggaaaaataaaaaaaaaagaatattctttatagtaataaaaaattaatttctattgcatgtgtttctttcacatgcagttaaaaaaatacctagtgacaaacttaggttataggacaggaaacaaattgtttgatcatctttggctgaagacgaaagctataaaatacatcaaaaaataatacctgtatcataccactaatttaaaggggtaaatcagaaattagattatctttgaaaaaaatgttgaaataggcaacatccaaaagcattctttttaagactaaaaattccatcccattagcactttcccagcaggcatccaactcatatgccctgagcaccttttatgtgccaagcactattctaatcaccgagtattgagcagcaaacaagacagacaaaatgcctgcccgtacagaggttatattctaataagtaacacaaacaatagaaaacagggagttctatgaagtaaaagcaaagtaaggaattgaaagtaatgggaagagaaagggaataaacttactctgaagtcaatctggcctttcagatgccaaattagcccttggcacttaaccatgtttaagacttcattatcattttttaaatatttcaggtaacttcaatttgtatgcacgtgtatgtacgtgaaactgtgtgtgggtgtgtgcttacaaatgtgagttatgtgtgaatatgcattatacacccatgaatgtatttcagtgacaaatacttactgcgtctgtgataaacttgaagacccctcagatttggaacattatctctcaagactattttgttggccccagtggccttatcaactctttcaatgacctcatactgttcatcagtataataaaggaaagaatcatggactgcaattccccaggggtgggaaagctggtgtaccaggatcattcgatctgttccatccacgtttcctctttcaatctaaaggattggaattttcattagtttcatggattcatagtgaaaattttgaacatttaaacactaatattctcctaattataatgtctcacatttatacagccctctatcccttacagagatttttcacttctattttctgatttgatcatcacaacgacaccaagcagcaggtcaggaaaatgtcactgtgcccctttcattgataatgaagacggagctcacatgagtcagtcaaccttttcaggtggcacggtgaagaaaagggagctaaaccactagtccctgcatgtgatattctggtcaaggatatactcaaacatctaagcgtgggccattgcacaggagctgactcaccctgagtttaacaccttcactgacaatttctgtaatggagattggaaatatgcccccaaacaaccacagaggacagcaagacaggacagggccaaaaatggtgccattaaatttgaacagataacaagctttaatcaaaatagctttggtacactggaaaagaactacaagaataaagtccctaagggaaaatgacaagtagtcagcttcttctggaagaaaaatgaaatgtagatgtagctggtttaatttcactccaaaaacctgcctcaagtgcctgctctgtgccaggatctgggctgggtattggcgagagacacagtgtggctttactgccatggctgaaaagggagcccagcagttacaagagtggttatgctgatgaaactgatcaaagttctagaatttagaatataagaaacatgagcctggaggagagagtggagagagtggaggccaggaccagattagctgagcaacctcacagaagtgttgggagctactcctcagggcaaggctccaagctgagccgtgatccaacttgctgactgtggctttatgaagaaaacatgtctccaacatgaaagcaggcttcaccactgaaggccatgcctagtcaaggccagagagaggttgctcagaatggtggaggtggcagaaaagatctgggcatgagtgacaggctgaggatggattgcagcatttggtgatgattaaaccaggagagtgaaggagaaataagggaactacactaggagaaaggttggagagtcacaccactaacaagcacgtagatttagaagctgtgccctgtcagatgtgtgtacagaaaccataccatgtaacaagagcttcctcgtcattgcacacatgcacccaactctgcaaagtgttttcacacacatcatcacttctttttaatctccaaagcttaccaccattataggtccatattcggagtgaagttagtacttgttgaacaaacaatgaactgaaagccaaacctactgcacaatattatgaaaagcatcaatgtcaaggatctgaagtaactactgttaaatagcaaggaagggactagcatatattcagttcagcacccaaagcaatgcttcatcaataattattattgagcattgtctatgtgcttagccccagctcagtgaaggtgaaatcctatttcaatgagtgaacgagactttatagtttctgcttcttattgtagaatataatgaacccaaccttggagttgaaaatcaccactaaagaaagtttcgcatgtgcattaatcatgttaaaatattagagaagaatgtgtagctacgaggggatgctgagttcagaaccttgctacgtaaataaatagatacatacatacatacacacacacataggtagatacatagaatatacctatatcctatacagatatataaattctatattctatatataatagatatatattctgtattctataaatatatattctatattctataatatatattctatatctatatagatcatatatagaatctatatagatcatatatagaatctatatagattctatataccatatagtatagatacatactctatattttttatatatatattctctccatatatataggtatatgtatattctctataattggagaacccagagtactttcaaagaaaaacactgaaatcactaaaccatgaaagaaatggctctgaaatgacaagtaagaaatgacaaatggaattaatttatcttgaagaaaaaaaaacgttggtggggaaattaataaacattaccctatagggaactatgcacatactataaagaactggacttcagctaggggcgaggtacgtgcaagggagagaagttattgggagaaggggcaatgaaacactggtacaagttaccaagtaagattgttcaagaaccactgcctgacagctcagaacactcagcatcagctacaccagctcagcataaagaccaaaagactgaaagggtgctcataccactcctcttccagtgactgcccagtagagtttctgctcttcgatgtcaagagtgacacactccaggtgttcgaggttcccagtaaagagagttttcacagatgtgccatccatgttagcactggcgatcttggcaggaaccccactgtcagttccttggtctgaccagtacagcttcctacaaccatgaaaaacaccagcatgtaacaaaacagaaggtggatttgagtcagtgacataaatgacaatgtgtattacttgtcctcaagatgctcacaatacaatgggcaaaggctgaaaatcaatatctcgttgcatacaacgtggaggggtacttcaccagtgttctaccaatgtcggtatatttcctagctataactggagtagaggccacttaaaatggtgtctggaataagaagctagggtatcccactggcagctgaacttttagcatggtcaggtgtgtgggaagcttatgacaaggaagaaacctacatcaataatccctccatcttcagtacatagtgaaggccaaagctaatataaaaagctgccaagtacactccctgatcacttaccaggcctcatttaattattccccaaatcaccatctaccacaagaccggctacttaattacctaacctgatttctgtgatgaaaaatgcaaagaattttgaaaactgacacagaaaataggagaaataatgagtaacacttttctgtgagagtggaatctcattatcatgctgttatggggtaaggaagacttcttttttctttctatttcacagcgatcaggtacacatgaaccataattaccacacagcattgccaaatccatgatatatgaaaatgtattaaaatatattaagggctgttttccatttccactgaagatgtaagttctagacttgaacccaacttttaattccttttgattgcacctccttctatatcttcaacagacaattctcctacattcttttctgaaaagtccttaaaccccttcatttaaatagtctttattcacctacctcttccaccaccaaatcaatatacccgtcctttgaatttcatcttcaactctaaacttctccgcctctaagttctcaaactctgaaatgctctgcttcgaccaaaacctctcatttcttccttgctttaacttttcctattaaacttgttctttgcccttaagccctgcctgagctcccaaccctccagttcttctacacctggacatcatatgtaaccatttcaacaatattcttatttattcttttgggttcccattgtgtctaagctaatctccaaccctgggtttctgcccttttttttctttctcctctcccatttcagggtaccaagagtttcctggacatagcacaaaactttcgtgaattctgaattcactaaaaatctaagttccctaatctaagctgaggattctcatccctagcagactttatatcatgttccgcatattgactatttcaagtcattctacttcataaatttcgaattccttccccataactttcactctcaatcaattatttcttcatccttgatctttcatctgctgctaaagaatacactcaggtttctctattctgaaagacattttcctgttacattttgacctacaagtttatctttctctaactttccaatacaaaattcttaaaagagtattcacatttcctcatcctccttccattcttttaacttctactatctctattcaacatcctctcttgaatatcatcagagaccctgtaactgcctcagctctttattagtgatcatccacaaagatatttttctgcaacaactggttcaataacatttatcacaactttatcaagactttctcttcactgagaatccaagatattagatcctcaagtctctgtcttgtttctcctcctatgtcctctgacaaaattctaagctcttctaattgtctcccaacccaactgggttgctcttagtcacttgaacaaaccctcaattttctgtccctttgctcttgaccttccatccttcatatcgcctgatatatcttaaaagctagctctgcccagtgaaattctaggtatgctttaagatccagtccaaatgatatctcttccaccaagctgaaatgtcacctctttatagcactatcatcccaatttttttagcctctcttgtggctcttaatcttatatgaatctgggttattgttatttatacacaggccttatcctccttactaagccataaatccttaaggttgcaaattaggtctttaatctttgtatccaccctctgaactccccaccatggccccatgaaagagactgcctccacttgccaaaattaatgtcttcctcttctctctgggtaaataggtggactgcatgtccttccgtgcagttagctgtggccatgtgacccaattctagcttaaggagtgtgagcagaagtggcgtgcactacttgtaggcctggctcataaaaacctcccagcaaatttctgaacgttctttcctttactgctcgaaagatcttgatactcagaatgacctaggaagcctcctactgaagatggcagagcatccatcagcctgggtcctgaatgactacgtagagtagagcttcctcccatcttctgcccaaaccccactgcccatataaaagacaaaaaaatttctattttctttgagccattacatatttaggagtttatttgcttcaacagttagctatcttaactaacacaccacccaacaaaggtacacaatgcagaaatgtctgataaacgaaaaacaaataatgagtgagcctgagtttcaaaagtagaatttcgaacctaagacagtccttcttctagaaagaataactgaaaactagtacaagccagcaggcacagaatagaatgtttgcttcttgtgccctttaaaaattggatttggtttccatgtcatccttatttgaaacagagcgctaatacaaattacttcttcagtgcccttctaggcctaagaatctgataactttcaaacattaagccaaaatccacttggaatgatgctacaatctctttaaaaaaaaaatcagtgttcatattttacaatttgttattctggtttataatatggtatagtagatcaacagaatgaaatagccaatcaaacagaccggaggactccagcctacatccattaagaccattttctcctaactggtctccctggccctggcctctctccacatcaatcctgaccaatttttctaaaacacaaatttggttctttcactcccttcctcaggattccttgctaggaagagaaaaccaaataccacatgttctgacttataagtgggagctaaacattgagcacacatggacatacacatgggaacaacagacactgtggactactagagaggggaggaagggaggagggcatgggttgaaaaactaactattgggtactatgctcactatctgggtacaatatacccatgtaacaaacctgcacatgtgccccctataactaaaataaaagttgaaattttttaaaaaaaatccctacttgctccttatcactcaaaagaataaagttcaacttcttagcatgatattaaaggccctccttgatttgtccccaaatgaccttatctgttgtatctcccatgtggtcaacagctccctactctaagcctctggttccggctctccccacaatcctgctaagtgccgccatacttctgtgccttcatggatcccttggcctcaagagtcactgcctggttgcaacccattctccacctactagaaggcttctcatcctgcaagctctattgcaaatgttacataatcccttagagctttccgtgtcctttcaaagtcagaatatattgtcaattcttataatgctattttaaaattcctaaaattcttgcttgtttggaattaattttaaatccagtgttgttcatttgaagaccataggacaaaatacaaacaatatcctgcacattaaatataggtcagagctatttctctttctcactgagatctattatttttcaaatgttgacatatgaaatcagaagatgtcctaaatttgaaatcttccattttgtcagaccctgacattaacaagaacaatgctgcatggaagacacgtgccatttatgaatactcacccacgagcaggatcaacagttatgccaattggaaagccaactccaagagctgtcccatcattggcaatcaatgtttttctgtatctgatatctccgtggagtgtcaaaacctatagcataaaatcacttattagaactgactttcataaggggaaccaaaggaaactgagatgaaggagaacttatgtacaaaacaaattccaaagcacgattagggatggatgagagaggatttgcatgagattcagataatctatattgcacttcagggaaatgaggaaattagctcaatagaaaatgagagtaagagcagcaaaatcacctcccaagttcctacttccaactcacctaaaatttcaggagggaacatttttatggataaaaggaagattcagttgggaaaacatacagagccactgcctaaagaaactgcaaaaatccttcaggagagctaagagaaatctctggaagacaaatgagaaccccacagctttcctgcaccccaccaaggcactcggtggccagttactgccaacacagttgatcaaaatagtccaaatttactcagaggtacagtgaattctgttccaagtcaacaaactaaactgaaacacatgagctgaaatctctgccctgccaggtcctgactgtacaatctgaggcaaataaattcacctctttgaactttatcagtcaaatatggaaggtctgcgtagaccttacgggactaagagataatacaggtaaagcagcacaccacccagcacaactatgttcaataaacttctattgtttaattggtccatctgttggtcacttactatatatgaggtattagagcaagcattattgtattcgatcctcataaacaattctgtgaggtagatcccattatttttctcaatacagatggagaaaaagaggcctacagaggtttagtggctttcccaaggctgtctgtgattattactgttataatcacagtgttaacagggccctgatacagcacatagaaatatagtttattggactagaaagaagtttcttacagcaatgaagctattttaatacgtacctaagacagtctaacagacaattagtaagaaattagaaaatgtctgttgatttttgcattaaggtttttctataaaattgcttttcaatacaaatagattatttgtgtttctctgtctctcatacatgcgtgtgcacgtgtgtgcacgcattcacacgcacacatacacacacacacacatatatccttctttccctcattcttttctctaaatttttttctctgcctattgtctggtatctttcactcttgcttggactaaggtagcttttcttttctcggtttgcctctttctgctacaatctctctccttttcctaagactaaggatctctttggttcacagttccttttcttgctttctggaatatatagagctctctctcacacggccattctgtaggcttcactacaaaattcagctataaaatttcttttagtggatgggaacacagctacccctagtggataatagtttcttcaatgtttctcttattttcaagttggagttaaacacgaactactcttaggcaggaaggaatattatacaggtaaacagaaagtgaatacgattcctattttcttaattaatccaacaatcacctggaagacttacttacaatttaaatgacctaaggggaaacaccagttaaaccattaaaagggcagtttgcccttggatcattattctcacaggtctttcatggattttctaaaaatattgatcatttgagggaaacagcgctctgtatttacaggatacctcagtgttatgaagtacttttacttcctcagccataaactccactgtacagatgagaaaacaggctcagagaagttaagtaatttgtccaaggtcgaatagctcatgagtggagaaaatgcagtgttgtccccagtcataaaatgcatttccatgtttcagggtctttattcaactgtttttctctcctgggacaccttttccctacgtcttcatttggcagaaataaaaacagtcatccccctcatccatgggggacaaattccaagatcaccaatggatgcctgaaacctcagatagtactgaatgctatatatactatattttttcctacatatacacacctatgacaaagtttaatttataaattagacatggtaagagattaaccataatctgaaaatagaacaattataaaaatatactgtaataacaattatgtgaatgtggtctctctctctctcctcccttttaaatatcttattgtgctgtactcacatattctcaggccactgcaggtaactgaaacctcggaaagtgaaaccctccgataagcaaggatgtattagtcatctttcaagactcagctcacaagtaaccatgaatgggaaatctgcatgctctctcccctcacttatacctctgcctccaatcactagcactttatattcaccggccttatcacacttatgacactggagcacaggtatttgtttatgtatccatctcacagatatgtgagctacttaaagacagaaaaaaaatgtttattcatcttaggatatccaggatcaactgatccatagaaagcatttcctagtgctcattaaatgaatgaataaaatgagcaagcaacccagactcaaagccaggtctttggactccaaatcaaaatatctttcctctgtaccacactgcatcagggcataattagaaacttttggttcatgtggttaaagtggccttaccaatccatacacacatgcacgctcagttattctccaactggccactactgcattgtacctaacactaatgggaaagacacgttccctgcttttggaaaactatcagtttaaaagaagagaaccccatttactaatcaagagacaaagagataaaataagagcatattaattgccatttggaattaagacagctttgcactgggtggactttagagagatgtgagtttggtagtaagggtcttaggcagtagatgttgcctgtttaatgggaggatgatagtcttagttgaaatcatgaaaaatattttctgccactgtcaaagagggttaaaccagtctggattgccggagttgtagtttataaaagtgcaaagagagaatactgctcaggaattagagcagtgaagctgaccatttaagacatcttcttagcttctgtgggccttggtttctgatgtaaaaaaataaaaataaaaaaaagagtttgaaccagaggagcctccaaggggcccttcatgttaacacctgataattctacctggcttgagatacttgtgcacactgcaaatttccctctcatcacaaatggctaccagaactgcctgccctcaggaatgttgtgaggattaaattagatgctagtgaaagatctttgtaaactcaagcgctgttccagtgagagctcttttctctgcctgggacaccttttccctatttcttcatttggcagaaataaaaacagtcatctgcactcatccatgggggatacattccaagatcaccaagggatgcatgaaacctcagatagtaccgaactctacataggctgtgttcttagtctacagagagtgctttttagtatagataggtgctctaaattagccagcaggctgctgtgcgccttgctcatcttcagtatctttctgaatgctccagagaaaaaccgtcttgccagctggtgcccacctaaagcagtggattgtcagggctctgctaactatccccctccaaaaacttctccttgttttgggaagtttcactttcaaaattattgtgaattaataatcccttccatgttttacccttctctcagagtggagcaaaccaacactagtcaagttacctctgacttacttcatgtgatttcatacctgtgcctcatctagaatttcttctgggaattagagtaaaaagaacacttatcttgaagaagagagtatcaaaggaattagaatcaagtttctactttctgttttgctgttagaaaaactgtactggagccatagaaagatttccatctaagaacagaggcaaactataaatttggttgagaactgaaatagcattgaagattagatgaggaaacatagtaaaattctctgcttaccataatcttccctttatgttgaattccttatgcaacttttatttatcttcttatatattattttgtaaattacctaaaacacttttatagcaacaaggtagtattgataattaggaggaaacaaaatagagcaatagaaagctcaaataatttatttttgccagccaggcgtggtggctcatgcctataatcccaacactttgggaggtcaaggcgggtggatcacttgaggtcaggtgttcaagaccagcctggccaacatggtgaaaccccgtctctactaaaaatacaaaaaattaactaggcttggtggtgcacgcctgtaatcccagctactcgggtggctgagacaggagaattgcttgaacccaggagccagaggttgcagtgagccaaggtcttgccactgcactccagcctgggcgacagagtgagactttgtctaaaaaaaaaataaataaataaataaaaataaatttaaaaaaaattttaaggtggttttcctctttcacttcagagactttgatagttaacactaatatcttttccctttttctttttgcttaaaaatgattccaaaatccacgtgagatctattcctgagactagagtttacatcaatctaaatccaatgtttgtgtaagtagtattatggaatcattacctcgattgactgagttctaggattggtagaataaaggtttcttgaaatccaatctaaggccaggttcatagaaggccccaccatagatatagaagcaaatactgtcctgttggtgccatctgtcttcactctgtgaatttcaccctggaaagaaagacaaggggaggtgagcagttccaaggccatggctcctacaaaagaaccctttcttcactgtggctactgccagctgctgtatttcttgaacagtccttacactcagaggaaaggcaaacaaaggttcagcaccactgggtaggcttcaaacgatttttcagtgtgtcacaggaatacacaaggcttaccattcaggctatctccagtactggctacagagatagttcttaactaccacaagcatacaagtcatgagaaaaacccaagtcacagatgtggatcagaagaccaggagtatattttgtatataggtgacaaacatgaaacacaaagatttttcttctcttcctcctttatagtcttcttgctctttccctattcttacaggttttttccctgaaggctgaagaaaatgacctctgaggaagagaactggagaagtgttcattcttaccctagaggcaaatattctaaaggattctaaaggaaggccccagcaccacatcaaatgctttcactaaattcccttagggagctactacttttatcttgagttttgatcatttttatattcgtcgaatattttctactagcttaagactcctctaggggcaagcattgtgactgctgcttcttggcatgtattctgtggttagaagcaggtaattcagtgcagggcaaatcataggcacttctggaaaatacttgctgaatgagtaaataatacacaatagcttaaatttgtttcttattctgaagctaaagagtgttatgatttttgctccaggccaagctcacatatatacccctcattgaatcaaaaaacttagggataaatttatttccacattgtttcccttttactcacatgacaaaagtttgcttataagaaaacatcagtgcaggcaggctcttcaagaataaattatatactttgaatgttattcaaaacttactggattttcaacccaatagatgtattgctcagcatcatcaaattcaacatctaaaccattctgtatccctgctatggggaccatagcatcattgctcttcacctcaggattaagggagattccaaaaattatatgttgccttacagttattaagaaaggttgatcatctgtgaaaatagaagaatatcagtcaaaatcatatcccactattcccagacatttagagtaatggaaggcaatagcctgttaccatcatatgggctaaaatgacattgcagcattgcagcaataaatataatgtacttcatcagacaagcatgggcctttcccagggtttcagtgggctgctggaccacaagacctccaaccccacatacaacgctgtctggactttttcaaggcaggttggtatttatcttactcttcattaagtccttacttacactaataaaccacccatgtttgctaaacctcacagacaggaagttcttccacttctacacacagacaaacctcactcacactgatctcagggaaaggagagttgagttttgaaaaaaaaaaagtgaaaaaaatcattgagactattcttgtgaaaggcagcttactagttttaagaatgttccaaaaataaaacaacactacaaagtgttgcctagtatttattgagactttaataaataaatccaatgtataatcctatcagttgttacttgactagtgtctctcttccctataagattttaactcccaaaggtcaatgactgtgtctgatttgctcattattgtgtcccagggcctggtactcagagcctggcataaaatagttgcccaataaatgtttgataactaaatggatgaccatatgactgcattaatggatgaatgtataagtgaataagtaaacagtatcttccaaagttctcaaaactgtctacacattgtaatttaaacattcccataatatcttaaactatcagttcacttatctccttaatagataataaaagttcctttttcaaaaataatttaatctttatcctgatccccatcaagagtggggttttaaaattcctctctgagaaaaggaaaacttttgaatctaagttttgggttaagatatatgtataagatatatcacatattaagacaaagtatgaaatgattaatcattacacaactttcataagctaaaaatgatgttttcattatttttataatccgggaagctttccatcttcagcaggatgacttggtcattttttctttacttattttcacatctcattagctttttcttgttcctatcatttctattactgagaaataacccagtctttattaacctaggacaaatttaaatttagtctaatgtaaatttcgcaactattaatgctttacatttttcaagtactacaatgtagagtcttccacaacaagcctgcaaagttgttttcagctggagcaaatgagatttgcaggagctctgtgacttctgcaggaaacagtaataggagatggaccctggctcattcacttccaggcccttcttctctcagctgctccacattgcctctcttctgaacaactgcaattgcaataaaaatcgcttctcattgattgagaatatgcgccatactgcatgcatcaggtaagtatttcccttaatttatctccctcaagtttcctaatcttgtttgttagataggtcctccctcaatttgcaaataagacacaaagaaatcaagcaatttaaacgaggtcacacaaccaggactcctggactccaaaatctacgtttttcatcactacactgcaaataccgcaggccaggtactatttcttgagtatcaaattaccactcatttcatttggtttaactgcaacagtaaaaaaaaaaaaaaaaatgctagattatgagtttcagctgtaccaagaaattatattgagatgatatttaattatttattgattatctgttattaatgttcactggctcagtagaaactatctctgtcccagttttatgggggactttaaatttttactcacttacgtaagatctgatcctgcccttttgaatgggtcatctccctttgcttaattggaataattctcaaccaaagcattgtttagggcctaaaaactttgcatatctcatccattatgcatgggccttcttgactcttccatggtgctcttcccttaagcaccacccgcttctactgcttcctggggatcatgtctcaagccctttatctgataactgctgatgtactgagaacgtttaccaccaatgaacatttgcaagcaatggaccagagaacaggatctcctgcaatgctgcgctggctgaaactgtgagcatcatggtgggggatgatgccaggggagtaatagaaaggaactggccagtaagacaacaggtggcgcagggagatgcctgaaaagtgctatatgggaaagcaaaaagaagtgacttcacaacactgcacacatttctacggagcaaacgggtaaaaatcagaggactggggaagtaacaaaaatggatattggagagcttgtcattcactcaacatttactgagtgccaccatgtaccacgaagtgccacaggcaataagcatacatctacagaccaggtagaggctttatcctcaaggaacgcagcatctagagggcaagaccaagtatatgagcccttacaattatgacaatggcatgaaggggtaggcacagaatcatctagggttggatggaaaggaattcaggaggtggtgacggttaagtaggtcagtgtgtctctgtcttttgaagttaaagatcatctcttcatttctattttccatgtcataatcccattaatgttagtgtcagcagagtcatgaagacactatagtcaggaatgagaactcagtgttgtaattgaacgacaatatatatgacccccaaacctaggtcctccttaagtcataccctgcacaagctgatcagcactgcagccttccctggagcaaggacaaggagtgttctcttatcttgcacaaaatcactgaagcaagtgccttgtgcccctgagaccgagtcagaagtctatttgtatttggagtaattttaggggtgctgaggtgatgtttggcttgagttttgtttgttcatttggttttggcattgtggggaatatattttctaaagaatttaaaaagtctcatacagagaaagcactcattataacataaaattagaaataagtagaaccatctcataattcccctatccaactgtaaccactattggcacttgtgtgtttttgcttccagaaacttgtgtgttttttaatgcatgtttttacaaggccaatattgtgcaatatctgcttcttttacttaacagcatcacagaagcacttctacatatattccagcctcttagtaaacactagttgaaaagctattcaacaatcaaatcaagtaaaatgtttccacctataaatgttaacaagttttctaaacttcttgttggggaaaaaaaaatgtggaaaccttttttcatttaacatatattggcaatcagttactcagctggtgctctgaaacctactgggaaatacttaaaaagttccacttcggtaaagtcaacccatgagaaaaccactagtggaattatttgtgaaacaacaaaaggcactatttaaaattaacacttatcaatcatcatcagagagtaatattgattacaccaacccccaatgtgcaattcaacagtctttgtgtgctgaaagaatgctttgtatccgaaatgtctacagcccagtttaatcttctcctgaaagactctaggaacacactaaattaaacaatgtcaacgaggattaggtacataataagtctctgaggaaaaatggcaagtgccagtccctctgtgagaattaccaataattaaaatctttcatcatgaaagtatcattgcacaatattacatgctgatggaatttgattttcagtaagcctacatctgcataatatctaaacactaaaagtttcctgaattcagtatatattttccattctagattaggactaaatttccttctagattaggactctattatctcttaatttaggaatatgtgatcattaaacatttaagttgaacttgtctacagcaattttcatcagtatcaaaatatattcattcagttctcttcactgagaaacgaaagggaacttgggtttagagtaacttcttagatttttaagcaataaggaattatatttttaagtgtattatatacaagtacacactccagaagaaatctcttttgtgaactggatgcaacttttccttcttttcttactcccttaagtacttggtataatcctccacacactcttcaatcgacccaataaaatatctctaggatgagataaatattaaattgctcagtcacttgtaatatctcataccaacacaattctccttcttaaagtatcagatggtaatagtaacagtactgaaattggagtcagaagacccaggctagaacactcattaactattggttataagaataaaaatgagacaatggagccaggtgcagtggtccacgtctgtaatcccagcactttgggaggctaaggcaagtggatggcctgagggcagaacttggagaccagcctgggcaacatggcaaaacccggtctctacaaaaaatacaaaaattagccgggtgtggtggcgtgcacctatagtctcatctactcaggaggctgaggtgggagaatcacaggggcccggaaagtggaggctacagtgagctatgattacgccattgcactacagtctgggcatcagagcaagaccctgtctcagaaagaaaaaaaaaagaaagaaagaaaaaagaaaaaaaaaagagggagaaagagacaatggacataaaaaatgaagctgtacacaaacgttgagaatgtttacttcttaggtgaagaatttggaacttcccattatcatggcttgtcagagaagtctaactgtacccaggtgagagaaaatatgaggttacagattgttcaattacatgcacagataacattagttccatatacagaaactgtattacaaccaaggcacacagtgacatcaccccatacaacacacatcattctgcagacacctgaggaatcaaaggacacagcacatgttcagtcgcaattggttttagagtttccactgcttggcacaaactatgaccagctccatcttcagagctcacataaggagcatactatacctctcaagcaattcaggagatcaggagacagactccatcctgaaggacaaacacaggagtaaaaatgaggcccctgtgaggaaagcaggcagagatggctgcagcgggaaaaggcacatggattcacggctgcatgagaaagagaagaaagcaccagtaagtggaaaacctccacattaaaatcaaaacagagtcatgctcttagtgtccttccagaggccccagtacaggggggcttaagtacgttgttacctctgttgttttcttttgttttgttttcactgaactactcacactttcaacttccctagcatcaggctttcaacttagaattcataagagacacgagagaggagaatgactcaaggttacagatcaatccagtctataactggattacgaacaaacagccactgagtaatctggaacttgtaatagaaatatgatgccaaataatctgtctccttacctgacctaaaagagatctttttgcattaaaaaaaaaaaaagttgtgtgtttgatgtgtgaccttgtagtttacctagagttttccagattttggttagataataatcttttatttttctactgatgatatctctgtgtgtctctgcaccttgaaaatcaggattctgtgtggtccccacacacaggatgtttcctagatcctatacatttttattacacataccatgttattaatagattattaatccattcattcaccagaaaaatggtaggtattcactgtaaaccaaacaccattctaagcactggggacgctataaaagtggagtatatattcgagcaaaaagaaacaactaaactcagagagagagagagaggtttcagaacatgagggtaaagagcaaaagaattatgagggggtggctattttaggtagagcggtcaatgagggcctctctgagaaagtgacatttgggtagaatcctaaatagcacgcgaagcaactcatgcagagatctggaagagagatgttccaggtagagggaagagctagcgcagaagctgagaggcaggagtcgcctgctgtgcttttggaccataatgaaatccaatgtggcaacagcgagtgggagaagagagcagggaaatagcagcagccacatgctgaagggtgtgagaaacaattggagagttttgaggagagaggattaagtgaagattaagtgacttatctccctctcccaccagaaagaacagtacggatgccaagtctttcacctagacacccataccatgcactttaggacaactcgtgctggctacagcagagcacctagaaggcagtggtgccataataaactagtcctaaaagtaagctgctttcaatcagagtggtagcggtaagaggatcgaaggcactatctggtctgtactccatttgtcagctgaggaaacggagactcatgtgagggtcaaagaggtagcagccaaatgctgaaatgatataattcagatgtgctgttattatatcctaggtttgaaatttccatggtaaataaaagtaatggcaatgtcaggactagggaaagtatatagtggggtggtttgtaaagagaaaaggaaaatgtattgtccaaacaaatgggtctgtaacagtgtgcatttagcattcccagggtcagtgtttttcaagctactcccaggcaggatgtttctctgtatcactcacaatttggttgtttcgaaggatgaaccgcaacaatcccaaggggccattgaatattatacattacaactgactggttccctccatgccacttgttggctcgcataacccgacgagtagcacggtcagtccagtacacagagtcttcaaagagagttagggcataggggtgccgtataatctgtgaggcagaagagaacagtgagacctcatccaaaaatcaaagccaaggtgcactgagtcaaagaggatatctgctcaagaagacggtttcctttaacatgtcattatttaataaaaacacaaggaagtcattgtgcaaaagagcggcaaaaaatacacaattcgtcctatatcccactaaaccattcaagagcctttcacatacacgtgccatttactctttatgtttgccttggtaattacactgggcatctattttacaaatgaaaacaaaactgaagcacaaaaagcaaggtgatgtatccggatcacctactagttaaaagttagatggaactagagagcttagagactcctcatctcccactcccacgccccagccttcactccaccatcagcacacttgtgccggctatttccacggtcttgtgctgccactcactgattcacatcaatctgttatagtttagatgcatctttccttcaagtcacagcaactatacaatagcaattttttctcttttttaaattgtttttaattttttattttttattttactttaagttctgggatacatgtgcagaacgtgcaggtttgttacataggtatacatgtgccatggtggtttgctgcacccatcaacccatcatctaggttttaaccctcacatgcattagatatttgtcctaatgctctccctccccttgcccccacccactgacaggccccggtgtgtgatgttcccctccctgtgtccatgtgttctcattgttcaactctcacttatgagtgacaacatgaagtgtttggttttctgttcttgtgttagtttgctgaaaatgatggtttccagcttcatccatatccctgcaaaggacatgaactcattcttttttatggctgcatagtagtccatgatgtatatgtctatcattaatgggcatttgtgttagttccaagtctttgctattgtaaatagtgctgcaataacatatgagtgcatgtgtctttatagtagaatgatttatattcctttgggtatatacccagtaatgggattgctgggtcaaatggtatttctggttctagatccctgaggaattgccacactatcttccacaatggttgaactaatttacactcccaccaacagtgtaaaagcattcctatttttaatgggggtcaataacagctctttgataaaatatctattttctttattttcccatttaacttgtgaaaataaattcaacagaatttatagaataaaaaatgttatgtgaagaacaagactgagaaatataaatctagttaatttttgttttttttttttttgaaaacagggtctcactttgtcacccaggctggagtgcagtggcacaatcacagctcactacagccttgacctccctgggttcaggcaatcctcccacctcagcctcccaagtagttgggactataggcaaacacccccatgcccagctaatttttgtatttttttgtagaaatggggttttgccatgttacccaggctggtcttgaactcctgggctcaagcgatccaccaacctcagcctcccaaagtgctaggattacagatgtgagacaatgtgcctggccaagttaagttataaatttttgcttgaaaaaaattttttttttttttgagatggagtctcactctgtcacctaggctggagtgcagtgaggcaatctcagctcactgcaacctctgcttcccgggttcaagcaattttcctgtctcagcttcccgaatagctgagactataggtgtgtgctaccacactggctaatttttgtgtttttagtagagatgaggtttcaccatgttggccaggctggtctcaaactcctgacctcagatgatccacccacctcggcctcccaaagtgctgggatcacaggcgtgagccaccgcgcccggccacctgacacaatttttaaaggtatagaagcaacagattcacatctgcagctcaactaaatcacacgagctataaaaatccttcctggatatggcacaagctgaccatgaactggaatgaaaatattcattttccagttagtcatatgggatagactgcctctcactgttgctggtatttcctggattgatctgacaatgtctatgacacaaaaattaatttcttagcttttctgatactcgtctgatttctacctatccacgactgtagttttaatttggttttcctcaccaccaacttaccaaatcactggctatcacctgtctccgatggtgtccattataatcacaaaagtccatgtaatcaagataggagtccatgaagtagagcagtctgttggggtagtcaatagttaagccgcagggccagaagatcttgtcctggacaatgacagtgcgcatgctgccgtccatgctggctcgctcgatgcgagggtggtggccccagtcagaccagaacagtagatgctcactgggaaaggaaatgagttaccaattggaggggacgtatttaaatattaaaaataactgtcattttaaataatacaacatcctgtttatgccctgcttaaaataaatcatctctggttcagaatatattcacagagtttattgtttcctctaagtgtcacaaagtaaaactgtcataacacaatcacaacccatctgggtatttttataatgttcataaaacatgtaatacataatgtcataatgtagtacattatgacattgaaatgtctcaatgccaattcatgtttgtttataatccacaaatagttgatctagaaaaatccatctgtccttgtttgtctaccctgtcatgtttttagataaggaaatcaatttattcttcatcaggaattcatcataaatttcagtggtgtgtaatactttacaatatctaggaattcaacatcacattgaacataacttgcctaatttaccatcctgcagaaaagaatctaagttataaaatataagtaaattcagggaaagaaatcctcaaagatttccaaacacatgggagaatttctctatcttcccttcaggatcagcaggcaaaaactgccttccttatatgacttaaaagggagctctaataaacaacataaaactgaagcagaaaaatccagcttttttgttgtataatcatgagttatcaaagttacatcaaactggcccctctatggactattactgcatgcagtaattagaaacttaatttttaattatatgacatttcaaaaattgtattgccaagctaataaatcaatgtgctcttaaaataaagtaaacaatcaattgctcttatgtactttatgaagaggatgattcagatgaaggagagatagcaacacccagttggacacctaccatgtttaaacaagggatcattttaaattttgcatatcagcaacatgcatatcagctacatcatgttactgttgtttttccctcatcataaccatgtcaaggcaacataattttaaaaaaaagtcttacttcattctgggatctaatgctagtcctcttggatttgttaggtttttactaatcagcacagtcctgtggctcccatcaattttggagacttcaattgtttccagagcatagtctgtccagtaaagattacgacctacccaatctattgcaatagtttcagtcaagatgatgctactgtcaaatacctaaagacaaaagtgaataaagagtgaattctagagcaaataaatgaatgcaaacatggatattatataaaaatctagattaaaccatctaacttgtcctataattacttgtggggattagaaaattttgtctcctcatgtagctaaccaccaaatcaacagcagggttttctgagaaaagtatacaagattttgtcacactgaacattctaagatgacttcattgtttggttagtgcatagtttcgttttggtttcaaaagtttttgcaattaagaaaaagctctatccatttgcttagttggcaacattacaaaatgttatagtgtttgcatgcaacgaataatatctctattaattaaggaccaagaattacaaaataaagttgtaagaggcagaggaaatgtaactatcaggagccaagaaactgaaattctgggagatggattgagaaatatcactaaattaaagctaagaaaagcaaccccttaactttcctgcactttcctctgctctcatccacaagaaaagactgcaaaaggaaccgtaaagacattgtgaggtctctgcatcacctgacctggaattcagaatcacacatctgcattcagaggccaccctcctatctaaaacagccataaattcgtagttatgaacacgcaagtctcttgggtatgatgtggcccagaaggtaccatgagagctacccagatgaggtagggccttctctcactggtgaataacagcaaacagacccaagacagaggaactagccaggccaaaggtcaacagaaatgtacttaccactcttctgtccgttccattttgaaacgcactccaggttttaccctgagttgcatcagaccaaaagatacgaccactaattgaatcaaaatcaacagctacaatgtaagaaccattctcgaccaatgaatagatattgtggacctgggaggtgacactgtcggcaataattttgttctgacttgccacaagtaacagcagactctcagatgctgttcaagaaaaaaatgcaaaaatgtcaatgatactgggagaaaacacaaaacaactctttaaaacttttgattcaatacttttggtaacagaaagaaggtgtaattccaaactatagtaagttggtggggaggggaggaagccccatatgaatgattttaatcacttcattcttaaccttaatagttagctggttttcatgagtacttaaaatagactctttcttgggttatatttaactgtgtttctaaatactagtctagagtaaactatgcttacattcttccttttactgtatttatttttgtactttggttatcttccttactatttaataggttgtaggcttctggacagcaggaatcatgtcttaaatatttctgttttctgaggccctcagctatggtagagagttctaattctcccaacaccccctctcttctttttctttttagtaataaagcatgccaagttttagcttggcacagactctccagccagagacatttctctccctccactgaagtttggagtgaccacatgactaagttctgaccaataggatgtgagtagaaattacgaatcaaatctcaggtcacattctaaaaaggaagctgcttgccctccactttctctttccccttcctactttctaagagaagctaaaacctggagcattggaacccttgatgtaagccacatgatgaggataacagagcagaccccatgccctggactctctgacatccagactcctactacatgtaaaagaaagaaactttctgtttttgttttagcttcctctatttggtcactttgaaagtggtcaaatcaatatcctaatacatagtaaaaagcactttcttatagcagaaattgaattaatactggttgaattcaattaagcattatataaagatgcttaaatatagtatagaactcattttaaattatataaaagccatttggtattattttaaatactttaaaaatcattgacttgtatatgttttaacctctattttccaaaatacaccaggattttaatgtgtattaccccatttaatcctcacaaaaaattgaggtttaaagagattgcataatctttccaggattcaagtcgatctaactcctaatcaacattgtcaaatacctacatgtgccatttgattttaagctctgggatgtgctgataaactggctcgggttagttcagcaattacctgtaactttgcaagtcctcccatcactttctaacatgtagcctgtatcacacgagcaccggaaagaacctctcatattgtaacagtgctggctacaagagcctagaatatcacattcatctatgtcttcacaggtcttagaatcattggcaagtaagaatcccaatggacataggcatttagccccaaagggctcttgaacacactcgtgagtacaaccaccattgaaatctgagcagctgttcccatctagaaaaaagaaagagaataatgaaaaaagaaaatcaagaatctttgcttctttgattcactcttatgcaatatttattatgcagtctcatgccaccttcaatatgatgcccagacaagagctaagtgcagcatgcacttgggtgagttccacaggctgttcagggtttgctctaatttgtctgaggatttaccatccttcatatccattggagtatgatcaccttcttcactacaacccaatagtataactccatttaatgcaatgagaacccttgggaaaatattgttgacatcaaggaagaaaagtgtcattgatagagcatgcaaagacacttaaaattgtttctcgttttcttcctctgaaattctactatctatacagaaatggaagatagacaaacatttaagagaaaagaccagaaaatctatgaagtgaacaaatcaaaggggaaaggtcattgaaatattagagtacacagatccggtaacatatcgtcatgccttactttcagggccaaaatgaaaatgcctaaagccaccctaagacagttcacatgcctggggatgcaaatgccttctatttccatgtgtactctaacatatttgtaagagtcataacacagaacatgcgttagaaagggaagtaagttaatataatcaggacattttcagaacaaacacaacacatatgaaatcataagaatctgaaatacttcacaatcatacctggctggggttcatctgagagtgagcattgattaaagaggaaagaaagaaatgacagtaattaggattacatgccaatcacagcactttaatcacagcaacacaaatccctggacttcatttttttgtgataagttctgattgaaattagaaaatattaaagttagaaaaattaatgagcacattaccaacagaaccaaatttaatttgacaatctaatggcctcaatttagtctcattttttgaaacaaagacataaaaagaagtaaaaacacataaccaagtacaaaggatttaatcagaaaattatccaatggtgatgtatttgaattcaattatggttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtcccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccaactagaagaaatttcttttctctgaacctccatagaattttatctgtgccatttctaagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccccactggcacacttgaattgagaagcagtacagtttaatactaagaatgaaagagaaaagcattagaaattagctcagggctaaaatgactaaacactgagatttttcttttttgttgttatactttaagttctggagtacatatgcagaacatgcaggtttgttacataggtatacacgtgccatggtggtttgctgcacccatcaacccatcatctacattaggtatttctcctaatgccatcccttctctagctccccaccccccaacaggccccggtgtgtgatgttcccctccctgtgtccatgtgttaacactgagatttttctaaataaacattgtgaataaaaaagaaggcaatgcacttaccacaaccaacctcatcagatccatcaacacaatccttgtcaccatcacagacaaacgataggtcaatacatcgatgattggggcaattaaactgactaggttggcatgtctctgtcgaatctaatgtcatccgaaaacaaaaccaacaagtttatttcctgtgcaacaagtaccagagccaaactaaaaatggctaaatagctacagaagttatctcaattgtacatgggttcaaaattcttttgaatcagccacactatcaaagtcagctaagcaaaagaactcaaaactaggataggttttagaattgagaataaaaagattacagggcagagtcagaaactgtgattacaccttggaaaatagaccacattcagaaagtgagcatcatgtgcttggacttggactacatttcatgaatactatgaagtccatgactctagaccaaagccaagcaatggagcccaatcaggcaacaaaaccagcatgacccacatgcctagtagcaacagtgtgtagacagacccccaaaactggatttaaaagtctgaacagaacaattctaaaaaccagggtcctaccttactgttaagaccatagccttggagtcggatgcagtggctggccccacccacaacatgaaattatattaaatacacacttatagggtatgaaagctagaagggatcttaaagctcatctattccaaatgatagtgacttgcctagtcaggcaaccaggactagaacttagcccagggaactttgctccatcttaaactattattgaagacatgaaataaaacaacaagctaaaggaaagcagaactggcaagatggaaaacaggtggataagatcaaaggaaatttaaattttctgtgcctctttattttgatgtctttttgcttgtaccaaatgaaaaagaaacatcaatagccaaaggtctggatatatctatatgacttttagtattgttttaaatatataaatagatagctgagggattttcactttttcaattcctatctgaattgaaatgtttggcatcagaggcagtccttgctttgcttccatagaactcaatatttgtaggtggactctaagaatcccatgtgcaggcacgtgcctttgttcttgtaacctattgacacagagattgacaagtggaatagaagtactaaagagacaatgaaaattgcatgagccttagaggaaagaatgcaaggccatttggttgttgaagtctatttacgaggctgaccaaccaagggaaaccagctcaaaacttactgcagttcttttcatcagatccatccccacaatcattgtctgtgtcacagacccagttctttgagatacactggtgattatcacaggtgtattgggtgtcaaggcaggaagcaggtgcgtgggtggggcagttgtgctcatcactgccatccacacagtcgttgcgtttgtcacagcgccagtgtgcaggaatgcactccccatggccacaggtgaacgccgaagatgaacaggtattatctacaatagtaacaaactggtcatgaagacatttgtttttacagccttttaaatgagttcttgccttataaaggctcagttcaccttttttaatggaggcattgtatataataaggagaaatgttcatcaagtgatgtcatcatcactaacatcattattggctggcatttatttggtatttatcatagaaaaggcatttttctaagttatgcacccacacacatcatataagttctctttaaatcctcacaagaatactataaagtacatataattgtctgcattttacagataaggaaattgagtctttgagagatttaggaacctgcctatgattcacgctctggttggattcactctaaagctcatccttaactttcaagctgttacttcctccaaccacaatttcaaattcagactatagaaagcttgaaaatatgtcatatgaaaagtgcaaatagataaaatattaaggtaaaatgctgtgctcttagaaacaagaagataatacacaaaaagatgaaaatttaaaaaatttcagaaaaatgtacaagtgagcactttactcttgcaaatctgtcactcctctttctctccaaaagaaaggttattattagtattaacttcaccttgatagagatttctgagatttcaactgtcctctatcttttttttaatttgaatgtaatacttttgccttctgcaatagtgtttattaggccccaaactatatagactagattaccgtcaaaagaagaatataaaggttaagaccaccatttcattgttaatttattttactctaacatgggagaaaaggaatataacacatgagattttccaaaggctatgattgcaagtagttattctgtgatactattctctcggttgctaaatgttaggtctactttatttttggtttttgttgttgttgttgtttgtttgcttatttttttgaggcagggcttcactctgttgcacaggctgaagtacacggcacagtcttggctaactgcagcctcaacctccccagctcaaacaactctcccacctcagcctcccaagtacaaatttttgtattttacaaattttgtgaaaatacaaaatacaaattagctgggtgtggtggcatgtgcctgtagtcctagctacttgtaattttgttttttttgtattttgtaattttgtattttgtaatagtcccagctatttgtaattttatatacatatttttttctgagctcatctatttcttttttatttatttattattattatactttaagttttagggtacatgtgcacaatgtgcaggttagttacatatgtatacatgtgccattttatattttttgtagagaccggatttcgtcatgtttcccaggctggtctcaaacttctggacttaagcaatcctcctgtctcggcctccgattacaggcatgagccaccttgcctggtcagatctagtttatttcgatttgactttttgaggagtttgccaagacataatgactgcattggtccaaacagccaatgtcaaggaaaaaaattgttgaagatagtctaaatcaaggccagaaaccatccataacattatgaatgaaatttcttgcttagcttcctaaaagccttcaaagtgcatgttaagaatctgaaattctaaaagatatttttcccatataaatagcccaagcttttatttattttctttaaagcccacctctactctattcatcccaggaaatatcgccagtgcatagctacttactaagtgtgccacatagttgctcatcactgttatcatgacaatcatcgactccatcacagagatagtaattgggcacacatctgccatttttacaggggaaggaaaataagccacactgctctgtgggtggttcattggttgggtccccctcgcatgtcaagtgattggaagccagcctcattccataagggcacccacacactcgctggaaatttggcaccgggaagcagaagtggctgcagtcaccgttaggatgcgtgggttgattacaggcgttagaacctgcaaaagcaaagccccgagggagtcagtcatgtacattttcactaggtaggtcacgggtttgatttgtgaaggaaaacaaacaggacaaaacatttttcagacccaatactaaaaagtagcttcctcttggaaatcaacccgccaaatacaacattccatttaggtatggaaaagtcccaaaatgtgtttttcctgacaacatgtttaaggctagcagcattgaacagagatttcaagtcttacactcttagattatgtgaacgacaagaatataaaactaccaggagctagacctttaagtaataagtacttaaagagaacaggagccactgtaacaaataaataaacccatacaaaaaaataaaaaaaactgggcaatctcactcaccagtctggatgttgacatcatacgatttcaaatgcagtatgtaagcaatgccacttcggataactgtcatttctccaccatctgctttcctgactcgaataatggcacccagtctccagtcagtaaaaaataaatgctctgaaaagaaacatgggtagattagtattttcagtcacagctaacttataaataaatcacttgagaaaatgcaataggcttgaaatgcttcttgcaagtacgatcatctcccccataaatatctgtaatatgtttctctaaccattttccacgacttgttactccctagtaatgctctgtggaagtctgtatgttaataatatcagggttcaggttcaggcaagcacatatggagttttatgatggcatttagtagcaattggatttagttctgcataggtaatagtgaaaataagaattggggaattcttctacagagcattaaatgaggcctcataggtctgcacccgctaaagcactcacctgctgagtgctcttaggcaaatactacgctgtgtgaaggagacagtctgaatcattcctgagatccttcccaggtcaaacagttcatattctatgttttaatgacagcgcttaaattgtaatttttttcccttgacttaaataagaagctgttgagaaggaaaagtacaggtctagcccaaaaaaggaactttcagtgtatgtttgaggatcaataaaaatctcaacacaagtgtggattcacctacaaccacactactaatgttagaatgatgctcacaatggtaagagagaggcgacataagattctaaacaacaaaaatttaatcatgttcactttacactaactattgcagcaggaaaataaacatatatttttaaaagaaagaattgcatcaatgtggattttctctttaatgatagtttaactagaaaaccctaattaatcagaaaatgtttaagatgtcataaattttatttgaccaatttccttatctgtggtctaatcaatgaccaatcagtcattggactccctaaatctttctagagcctggcaatcccagtcccactactaacaaaggcatcctcatatacttaaataagtaaggagttcaataaatcttttagttctgtgtggtgcacaatcaagaagatctagccctttagtaaaaaggtacacaatttctatggtgttgcacaacaaaagaactttccaaaagaaattcacaaaaaacagcaatgttgaggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagagcgaggcattgcctcacctgggaagcgcaaggggtcagggagttccctttccgagtcaaagaaaggggtgacggtcgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagacagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccaggaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagtaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagtcttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctgttccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagaggcacaaaaaacccttcaaaaaatcaatgaatccaggagctggttttttgaaaggatcaacaaaattgatagaccgctagcaagactaataaagaaagaagagagaagaatcaaatagacacaataaaaaatgataaaggggatatcaccaccgatcccacagaaatacaaactaccatcagagaatactacaaacacctcttcgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcaaatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaatgatgagttcatatcctttgtagagacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaacagcaatgttgaaagaaataaataattattgctattttgggaatgttgtgttgtcctcatgggtatgcattcaaatttttttcatactgatgaaaccaaaagatactaaaactacattttctcgaatcccaaaacatcccagcccagagcagagaaaattcaactttttataatgtttctatgtgacagcaaatagcatgtgtctgacatcattagtgaaaagggagtaaatggatggcagcggcgggagggggacgggaggagtatttataattaactcatcaaaaatctcatgagcattttttaaataccacacactcctccacagataaacagacagcaggacaagatatgcaatatacttactaactattcattccacacatacattctatgcatgtgagaaagtctttgatttatagtgagtgtctagtcttttcaagcactgtgttaattattcaaagtaggaggtttcaaccagggacacaactagcatatacacagggcttttggtagacttaaacaaaacatgacccctctaactggagtaatcatggtttgtcaaacagacccaggatagatttcagtgtctcctcaccctcttggcctggcatttttatgcagtgcacaagctatacaaccattcacagagctcctgttttcaagactaagcaaaccacctgtttcatggtaccaggctacattcttattcccagaaactcaactcacagcagcatgcctgcactcaaatggggagctgagaagacaggcaagcactggctgtgctcattgtgactgtagttccccagaattcatgcttctcagcaatcttcactagtagcatgaaattatttggaaaggttgacgaaaaaaaattatgtcttgctgttcttcataaagcataacctaacacttccataaaacaaagacgatgtcagttctccaacattttgaataaaaaagtttcaaagtcattcagtcagcatatagttgatgaatatgtgtaatcgttttttccacaaggatttctaatgagattcttacaaacactggagaataatgaaatgctacaatgattactataaacagctcttgctgttttattcttgaaaatgaaggcagtaatttactgtttcctcacgtgatacttgtataactaagtacttgggatgttgaattgtataatacatgtaatctacaaagtgctgtacccatatacactgtcaacattatacgaatatatacaaaacaaaaatcacactctaaaaatgaaatacaccatcaacaaaccaaatgttttgtctaaatatatagcaccattttaaattttttcattttaaagtggccagcttttctgggattgtgaaaatgccacatgaggatgagtttactattgtaacttgcaatgtataaaaacaatacatacttttattgctttaaaacatacctccaaagatggcaagtccaaacggatgtgtcatctgctctatatggcccagtcttcttctgtctaaaccatcaaaggtgctgtgctcaattttatcaaaataggcatctacccagtacaatcgtgaagcactaaaataataaaatatttagttatctcttatccaaaaactatcagagcaccctttacacaaagggcatccaaaaacagtagggtcagttgacacatttattaaacaaagtttttaaaatttaaattatattcattaaaaatttaacagttttatgtcccccagaaagagacggctacttttcatgaagtggctttcaatcaattgtcttagaaaacttaaaatgttgctatctttgagccagaaattttattttctccttgtgaaatcaacaagttaagaaaaacagtggtagtaatctatgtttaaaaggtgaaatatatttcttccctttttttctcccataagttaccttggcatttcatctttataagcttatttactctattccttttcctatattcctagatagatcatcaatttcttgagaaccatagcttatacttttaaagtcctcccaaagtgcatgtaagcaaaggtgcatttgttgattaattgactccaaagatttcctaaactcaagatgttccctgtaagaaattacacactgcctacagttcaacaaatctgtaccctactttaaatgctgcttgggacccacctcccccatcttgagtttccactaaatcttgtcattcagctttctctagcaattttctcagaatactcatgaatttattagttttcaccccagcagtagctggccaactatgtttatgtcctttgtgttcttgttcaatatccttctcccatcaccaattaattatttaaaattccgcgagggcaagcagtaccagtttccttacaccatcatatcacccaacctgcctcattatgtgttctgcagtaaaagagaactaagtatcggggatgatgattcctacttacgcccaatcgatggccaagccattgggccatccaagagtagtgtttattacaggcaagaggtgagatccgtcactccatgctctcataattttagcaggacggaaccaatcagtgaagaatagatacctagaaaaagcagtagtaaattaaggctgttaacactgggacaaactacatgacttccagagatttagaacaaacagagattctccagatactgcaattaattttgttttctttatatgctattgaacttaacatacttagtgtataactcatgtaattctcagttaaaatttagttaacatgtaaccaaagtcacaaatacaaatggcatttaaatgggcattgagagaagagaaccactgtctcagagtttaggaactaaaactattgtcgcctaacatattctctaacaagacacaattcaggttacctattaaatattccacgttattaaaataaaataataaacaacgaacagagcaagaaaacatttcaatctctttctctctagattaaacattcaggatcctctagtcattcttccataaggaattgataaatttgcaggaaaccattcatctcagatgaagaaagcatccaaatcaatgcaatgcaaacagtatctgacccaagcatttttttaatattctaaagagtgggaaaaagataagtctagaggcaaaaaaaaacaaaaacaaaaaaaaaaaacacaaaaaaaacaaaagaaaataaaaaaacaactttttctcttttatgggatccagaggaatcaaaattattcttttccaaaatgtaactttctgaaatgtaactacttcatatcattttaaacaaaagagtcatcaggaaaggaattcaacagtttttcaaaaccaaaggccaaaagtttgagttaagacaaattcattaaaaaactaaactgtttaactctctatagggcaatgaaatttcttatcaataataacatcagttttaaaatgtgtttcttttattatcttacagagaggaaattaaagcagatactctagatgcagcaaacagacttttttaggcacacaggcattccagtcagacaggtctggaatttgaatactgactgttgcctaatagctgcgggccctttcacaagtcactttatctcactgcgccttagattcattctctctaaaatgggtatttacacatacctccttcacaaactagctttggaagctgatgagattatatatctaacggaagaacaggtatggatgttccctgggtaatcaggcattggtgggttagcagccatcttttttatcattccactcatatacaacacatagctcagatttgttctaaataaacacagtagctgttaaacatatttaaataagaaaagtaggaaccaaaaaggaatactgtgaactcttctgtctttccttgtctggcaccaccaattatagaatggtaaaacatgaaactttgtggtctgaaaaactttttattctgaaaactactgaatgattaagcaagttttgctaagctttatataaatatattaaagcagggaaagaatttgggtctttcctgttaattctgttgcctattcactccttttctactgaatctatatcacattgtttggtcctctgcaactgtgaaaaaaactactcttcagtgaagactgagaaagccaaaagttagaagaaatgttttgggtttaaaaacaattttttttactcccccagaataaagttttttggaggaaaaaagaaataaaatttaaggtgatttcaacttatacagttcaatcttatatttgctgaacttacctaaatccctagggcatcacttttcaatgactgtaaaagacatacagtttcaagctcttaggaaaacatgaacacacttacccggcaaaaggatgaactaccaccgaccgtgggttatttaaatactgaactactgtgcgtctcgttttatcagctagcctcatgacactgatactcttgtaatgagagtctgtccaatagagattctttgaaatccaatcaaaagccaaactttcaacattttccaccctgttagctgcgagaatttctcttcctataagttaaaatatggacatattttaagctaagtatattttgtaaggcatcaattttcctactaatgcacactgaaattttgtgtcagagttagagcatatttcaggaacacatgtggaattctttaaaaaaaaaaaaaaaaaaaaactctgtaagctgctgagcaataacatgagacaaacctagaatctatccattcctcaaactttggatctcaaagagtagatatgatactgacaaacagaaccaggaatggtatggcctggatttactcccatgtccaaccttccagaaaaaaatttctcactgtagaatatctgaagaagagatacctgagttcacctactaccacccggagacggctctgataagctgacaccaccaggtacgacctgagggtaaccctgaggtatcatcgcccaaccctctcatcaacagtcttccacagccacaaagttgccaagttttgaaaacaccagcagagataccagaaaggaaatcagaactgattaaaaacaacaacaacaaaaaaaaaaaaacgctttcctctttatggagttattatgctttcttttaccctcttttttctttttttcactaaagaaaatctgaatcagaataaacagccatacctctttcttttgcagtaggaagaaaaaatcctactactttttctcttcatttattcagcaaattgtgaaaagaaagttctctatgtgatagaaagccaactatatatttagaaaacacaatattgttagtagtgttaataatcacagcttagattaaatgagcacttactaggtggcagaaactggaccaagtattctacatggattcatccatcctcacagccactcaatcaagtaggcattagtatcgttcctattctacagatgagagaaccaagtcaaagagaagttaagcatctggaaagaagtgtggacaccaccctcaaggtaattcatagtgaggtggtgaaagaggaggaggcaactaggccaagagacaaaaataaaagagtaatgagtgctgagatggagagatgcataggatggtctgagagcacagattcctaatgggccacatggcaaagcagaggtctggggtggttgacagacacagagactgaaaactctacatgttctaggagtgtggctggaggttaatgagttaatgatagaggctaaaagagagggagatgttcatgatgaccaccaggtggggatggggcaccaaggaaggggtgagtggtcatgcccttcctctaaggcctgtgagaagttggatgaagcatccacttagacatgttggtttagaggtgattgtaggatatccaggtgacgtatccaaaaggcagctggcactatgggtctgaacctcagagagagaacttgcatagagatttttatcatgacctacagaaaggcttgcttggtctttccctcattccccagtttaggaggaaaaacactcagtaaatgcactattataaaagtctccccataattatttatagttgctacatagatagtaatcaaaggcaggaaaggtgtgaaattattcagagagaggaggaccaatgttgaacaacagatttacagttttttatagaacaggagaaaaagaaaagatctccagggtacactagaaaaaaaaaaatgatcaagaaatagaaggaaatccaggagtatgctgtcatggaagaaagaatatttgagagaagatggctgaagtaccaaatacaggactgataggcattatttaatttagcaagaaagggattagaggtgaccaggatgagaggggtgtcagccacctggtgggcagattgcaagaggtgagtaatcagtgagaaatgtggaagaagggataggaaagtgcaaaacaacctttcaagaaacttgaccatgaaatgcagagaaggggttatcactaaagaggaacatggagtgaagggtaagttgcatattttttaggatgggagaaacttgagcatatctgatgatagggaaaagtcagtagaaaaagagaatttggaaaaaagaaggtatcattgaaggagggagttctcctgagggcttcattcagctaatcctgacttttaatatgatttctttttctttttctttagagacaggtcttacctaggctggagtgcagtggcacagtcatagcccactgcagcctcaaacacctgacctcaagtgatcctcccaagtatctggcactacaccacaccaccacattagctaatttgatttctgacaactcatttcctgcatatactgtgtactcattcaaaaaaaaaaaaaagaacaatgtaatgcctccctcaacaaagcatacagagtttaaccactgactatgaggaatattttaaaaggtaggttgccaaaaagagtccaggaccagatggattcacagccgaattctaccagaggtacaaggaggaactggtaccattccttctgaaatgattccaatcaatagaaaaagagggaatcctccctaactcattttatgaggccagcatcatcctgataccaaagccaggcagagacacaaccaaaacagagcattttagaccaatatccttgatgaacattgatgcaaagatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaagtcaacaacccttcatgctaaaaactctcaataaactaggtattgatggggcatatctcaaaataataagagctatctatgacaaacccacagccaatatcatactgaatgggcaaaaactggaagcattccctttgaaaactggcacaagacagggatgccctctctcaccactcctattcaacatagtgttggaaattctggccaggccaattaggcaggagaaggaaataaagggtattcaattaggaaaagaggaagtcaaattgtccctgtttgcagacgacatgatggtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagctcatatggaaccaaaaaagagcccgcatcgccaagtcaatcctaagccaaaagaacaaagctggaggcatcacactacctgacttcaaactatcctacaaggctatagtaagcaaaacagcatggtactggtaccaaaacacagatatagaccaatggaacagaacagagccctcagaaataacgccgtatatctacaactatctgatctttgacaaacctgagaaaaaaagcaatggggaaaggattccctatttaataaatggtgctgggaaaactggctagccatatgtagaaagctgaaactggatcccttccttacaccttatacaaatatcaattcaagatggcttaaagacttaaatattagacctaaaaccataaaaaccctagaagaaaacctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcacagtgaacaggcaacccacaaaatgggagaaaatattcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagacataccatttgacccagccatcgcattactgggtatatacccagaggactataaatcatgctgctataaagacacatgcacacgtatgtttattgcggcactattcacaatagcaaagacttggaaccaacccaaatgtccaacaatgatagactggattaagaaaatgtggcacatatatgccatggaatactatgcagccataaaaaatgatgagttcatgtcctttgtagggacatggatgaaattggaaatcatcattctcagcaaactatcacaagaacaaaaaaccaaacactgcatattctcactcataggtgggaattgaacaatgagaacacatggacacaggaaggggaacatcacactctggggactgttgtggggtggcgcgggaggagggatagcattgggagatataactaatgctagatgacgagttagtgggtgcagcgcaccagcatggcacatgtatacatatgtaactaacctgcacattgtacacatgtaccctaaaacttaaagtataataataaataaataaataaaaataaaaaaattaaaaaaaggtaggttgctcagcatacgaacttgaagtttaccaaaaatactatgagaattccagatcaacaaaacagaaggaagctgacctgtggaggtgcctgtgggagacttggcctgcatgcagctagaaacccaatactaccttttcctgagaactaagctcgactgcagtgctccaagctcagtgggcctgattctaagtcctcaaaaaagataatttctcattcaaaatagcagattgacaaaccaaacatgtttatctcctcttcctccgaaattctacttaaaagacagtaaaataacagcagatgagtaattccaacaaatgtttgaaaagtaaggtattggaggagtgataactcagttaagaaggggaaaatgctacaaactaagtgtcaacagaagagagacacacccacatatgcagaagcctcagtgcactcacactcagaggcaccaggtcctaacaaaggcaggggcgaggaactaaggggctcagataaagcaagataaggagcaatccaatgcctaggtccctcccagatcctgagtgtcacgccactcctctatctcctctaagggaccacagattttctctggaggagctgaagcagaatggctatgggttcaaggcacagtcctcaacacagaactgagatggatgtggaactgagtacaggaggattataggaatactgaaagggcgccctcagctccctttcctctgcccactcccagaacagaccaccatctccccacatcttccccttaccccaagaaggagaatgaaggcatctatgaaggagaaattaatcacccccagaacagaccaccatcttcccacatcttccccttactccaagaaggagaatgaaggcatctatggaggagaaattaatcacccccagaacagaccaccatctccccacatcttccccttacctcatgaaggaaaatggaggcatctatgaaggagaaattgaccatctccagaaaagactcactaatgttgccttggggagcaatctggcaaccaagccaccttcctgcctgaagctcaccagctgacaaggcctatccacatgtacagacttttgggtcaggttttataacctcacccttaataccaaactagcaactcagacacttggaaaaagcttccatcaaaaagaagaaagttgaaaagaaatcaaaaggaaaaggaatccagagaaaatggaaacagaggaagattaatttttaatgtcatatccatatccatatcaaagtcatatccatagaaatggtactcagaatggcactggactcaacactagatattagacgtcactagagcaatgtcttcaaattccaggtttaaattaacttgcaacctgtacccagccaaacagtcaagatggagagcaaaataaaacactcacagacattcaaagactcaaaatatatgccacctacttatgtttctcaggaagctatcatgtaacttgtttcagcaaaatgaggaaataaatctagaaaaagaaataaatggcctgccacaaacagaagttccagcacaggggagtggcaaagagaagtctgtgcaccaggccagagaaaaacaagtcccaattggaacacaggataggggtctccagaaagaaaaaaaaaattatagattgttttctgtctttgtacaggcatttgatagagctattagagcatttggggaaaatacatgattgttatatttaaaaactaagcaaatgaaaatggggcaattgtcaaaaattgtcaagaaatgtcatcctagaatactaattggctgagcagtgaacaatatttatatttatattatgttaataatataaacacatatgattaatttaaccaaaaattataatctagctttttaaggagaatggggggagggaagtcagaagctgggagagaagaatgatgtaagaaagcaaaacgctcacctagaacaaggaagtaaatatcaaaaatgataaatcaagaaatagaagtataaacaaagcatttagaaacatggagacaaacaaaagaagaaatagtcaaaagagctgttccctccccagagcaggtctggattaggggcaggggagggtgggcaatatggttttatattgataacagataaaatgatatccaacatttactgaatatttactattttctagccattactctaggtgtttacatgcattagccaaaaattctctcaacaaccttatgagcaatatatgaaccgcatatttttcagactagaaaattgaggcaaaaggaaattgagtaacttccccaaagttacaaagctaggaaatgtgggaagctggaatttggaaccaggcagtgtagctcctaagctggctctcttagttggtatgttatattgcttacaaattttattactattacaaaccaaacccttggcatttacatagtccagcatccctgaagagatgtcttcccctttaatcaatctggctgcttgagtatgaaaaacagtgtctagtcaattaatctgttaatggctctcatacacgtgacatttcttttatgttaacattggtcattgttaaaatacacacacgtttgtaaccttttttttttttttttttttccgagatagggttgcactctgttgcccaagctggagtgcagtggtatggtcatagctcactgcaacctggatctcctgggctcaaacaatccttccattgcagcctcccaagtagtggggactacaggtacatgccaccacatctggctaatttttttctttttttggtacaagtggaatctcactatgttgctcaggctggtctcaaactcccggcctcaagcaatcctcccgtctcggttcccaaaaataacgtgtttctaaaataaaggaaaggtgtttgttttaccttaatccataaaaaagcaataaatttattttctcaatctaaaactatttaggaagcttagtaaaatctctgcttacataactatccaccccaaatcaacagagtatacattcctctcagcaccacatcgcacttattccaaaattgaccacatagttggaagtaaagcactcctcagcaaatgtaaaagaacagaaattataacaaactgtctctcagaccacaaggcaatcaaattagaactcaggatccagaaactcactcaaaaccactcaactacacggaaactgaacaacgtgctcctgaatgactactgggtaagcaacgaaatgaaggcagaaataaagacgttctgtgaaaccaatgagaccaaagacacaacacaccagaatctctgggacacatttgaagtagggtgtagaaggaaatttatagcactaaatgcccacaggagaaagcagtagagatctaaaactgacaccctaacatcacaattaaaagaactagagaagcgagagcaaacacattcaaaagctaacggaaggcaagaaataactaagatcatagcagaactgaaggagatagagacacaaaaaacccttcaaaaaatcaatgaatccaggagctggttttttgaaaaaatgaacaaaattgatagaccgctagcaagactaataaagaagaaaagagagaagaatcaactagacacaataaaaaatgataaaggggatatcaccacccatcccaaagaaatacaaactaccatcagagaatactgtaaatacctctatgcaaataaactagaaaatctagaagaaatagataaattcctggacacatacaccctcccaagactaaaccaggaagaagctgaatccctgaatagtccaataacaggttctgaaattgaggcaataattaatagcctaccaacccaaaaaatgtccaggaccagacggattcacagccgaattctaccagaggtacaaagaggagctggttccattccttctgaaactattccaatcaaagcaaaaagagggaatcatccctaattcattttatgaggccaacatcattctgataccaaagcctggcagagacacaacaaaaaaagagaattttagaccaatatccctgatgaacattgatgcaaaaatcctcaataaaatactggcaaaccgaatccaggatcacatcaaaaagcttatccaccatgatcaagtgggcttcatccctgtgatgcaatgctggttcagcatacacaaatcaataaacgtaatccagcatataaacagaaccaaagacaaaaaccacatgattatctcaatagatgcagaaaaggcctttgacaaaattcaacagcccttcatgctaaatcaataaactaggtattgatgggatgtatctcaaaataataagagctatttatgacaaacccacagccaatatcatactgaatggacaaaaactggaagcattccctttgaaaactggcacaaggcagggatgccctctctcgccactcctactcagcatagtgttggaagttctggccagggcaattagtcaggagaaggaaataaagggtattcaattaggaaaagaggaagtcaaattgtccctgtttgcagatgatatgactgtatatttagaaaaccccatcatctcagcccaatatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcagcaaaataaaagaggacacaaacaaatggaagaacaatccatgctcatggataggaagaatcaatattgtgaaaatggccatactgcccaaggtgatttatagattcaatgccatccccatcaagctaccaatgactttcttcacagaattggaaaaaactactttaaagttcatatggaaccaaaaaagagcctgcattgccaagacaatcctaagccaaaagaacaaagctgaaggcatcacactacctgacttcaagctatactacaaggctacagtaaccaaaacagcatggtactggtaccaaaacagagatatagaccaatggaacagaatagagtcctcagaaatgatatcacacatctacaaccatctgatctttgacaaacctgacaaaaacaagaaatggggaaaggattccctatttaataaatggtactgggaaaactggctagccatatttagaaagctgaaactggatcccttccttacaccttatacaaaaatcaattcaagatggattaaagatttaaatgttagacctaaagccataagaacccttagaagaaaacctagacaataccattcaggccataggtgtgggcaaggacttcatgactgcaacaccaaaagcaatggcaacaaaagccaaaattgacaaatgggatctaattagactaaagagcttctgcacagcaaaacaaactaccatcagagtgaacaggcaacctacagaataggagaaaatttttacaatctacccatcttacaaagggctaatatccagaatctacaaagaacttaaacaaatttacaagaaaaaatcaaacaaccccatcaaaaagtgggtgaaggatatgaacagacacttctcaaaaaaagacatttatggaggcaacagacacaagaaaaaatgctcatcatcactagccatcagagaaatgcaaatcaaaatcacaatgagataccatctcacaccagttagaatggcgatcattaaaaagtcaggaaacaacaggtgctggagaggatgtggagatataggaacacttttacactgttggagggactgtaaactagttcaaccattgtggaagacagtgtggagattcctcagggatctagaactagaaataacatttgacccagccatcccattactgggcatatacccaaaggattataaatcatgctgctataaagacacatgctcacgtatgtttattgcggcactattcacaacagcaaaaacttggaaccaacccaaatgttcatcaatgatagactggattaagaaaatgtgttacatatgcaccatggaatactatgcagccataaaaaaggatgagttcatgttctttacagggacatggatgaaattggaaatcatcattctcagcaaactattgcaaggacagaaaaccaaacaccacatgttctcactcacaggtgggaattgaacaatgagcacacatggacacaggatggggaacatcacacgccagggcctgtcgtggggtggggggagggggagggatagcattaggagatatacctaacataaatgacgagttaacgggtgcagcacaccaacatggcacatgtatacatatgtaacaaacctgcacgttgtgcacatgtaccctagaacttaaagtaaaatagtataaataaataaataaataaataaataaataaataagactgcttaaaaattagatactgagttttaattatcaagttgtaagtatcattacaataaacaggcaaaacacgcatacacacacacacacacacacaaacctttctcacctgtgccatcaatcttttgcttaaaaatcatgtgttttgacatatctgaaaaaaagatagtgctgtcctgggcgtcaaaatcaatcccgacaaagaaagaaggattccccgaaactggaaccatgacatcttcctgggtagacaaggtgaacgggatcccacgaatagcaacttgggatgaaaaaatgaggaaattctgaacagctgtaggaagaataacacagcacagtcagtcacagcatggttcttttctctcctcccaaattccagataaatgcatccacagagcaaactttaaattataaaatataattctgaaataaatgtaaaaataaatttttggaaagcatagttagaaataatacagggaagaaaaaaagataagcaactatgagggagatacaagtattagaatcttccttcttcctaagaaatgtatccttaaaatgtatttatatgaaaaatgatatccatatgcttaatttataaaataggagatacatctaatgtaatgacgagttaacgggtgcagcacaccaacatggcacatgtatacatatgtaacaaacctgcacattgtgcacatgtaccctagaacttaaagtaaaatagtataaataaataaaataaaaaggactgcttaaaaattagatactgagttttaattatcaagttataagtatcattacaataaacaggcaaaacatgcacacacacacacacacacacacacacacacacacacacacacagaaacctttctcacctgtgccatcaatcttttgtttaaaaatcatacagagctgaactctatagtaattccgtaacaatcctcaagttggtttaacttctgcatagagatctacaccaagaaccttacagtagataccaagataattaacagcaatcagaaatataaagatataaaggagtgaaagcagggaaggaaggggagggataaaggaaataggtaagaagaagtgatgtttaacagcaaagaggagactgtgacaggatgccagggagtcaagaagatgaaggaggtatgcccaagacaaagataaaaatcgcagtaacggaatttaaaagcaaaattattagacaacgcactattgatataatagttagaaatacatgttgtttttaatgagggtgatttttctgaatctaaaactacctaagaagttaacaaatgtgtctgggttagaataagataatttatatacgacgctagaaaccgcaacatctggagagcaagaatttgtcacaggcacagaaaggagaaatgtagaagtgaaaataagaaaaacaaatattgtaggagtgcatttcatcattagctggggcccaggcgatggcttaagtgtgaatagatgtgtaggaaaccaaagaggaagaaaggaaaccttcaaggtaagaatgaaatcaggaatatggaggcagatacaagaaagtttgaactgaaaggtgaaaaactgtgtgagtaactgagccaccccaatgctcaggagtttactttggaatacagagagaaaaaataagccagataagattcagatgtgattacctggttgaaaggggcatacgtggtggtctaggagaagtcaaagtggggagaagtacagtacttcccatcaaagttaaggctaacatctaaagtggaaaaggtatacatagcatagaaaagagctcaaagttcaaccatatggaatttcaagatcatagttaataggagaaaaaggcttcaggaaacaaagggggaagggaacccaagaaaaccttagatgtgggattaaagcaaaatcccaaaagacagaaatttacattttcaaacatagttctgtgtatagtagaagtggtgcctaccaaggaagatgccctgtgggctacagaaagcttatttgcagtcaagaagttagacagggagctggtccagttcaagagtagcagttagtctagttagaggtttggacacacatacacctgtgtcacctgccaacaacgtccaaaacagacttcttaccaatgcagtggcgctcatctgtatccagttggaagccgaatgtgcacttgcaacggaaacccaaaccatcattatctgttctgtggctgaggacacagacctgctcacagcccccattgttatctttacacggattggtagctggaaggaaaaatgcacagggttaaattgcaattagaaatgtgtaattatccaagacatgaagccacttctagcccttttcacctataggtgaaatagagtaatggattagcaacgtgttgaaaacattactactggttactactggatacatccacatctggctacactaaccctcccaatttcactgctgctctcccatccactctccaacagacggtggcaaaaaaaaagaaaggactcctacaactttctccccaataattatgtcagagtatgtctgctatcctccatgattagaaataattgtcaaaagaaaacccacacttcactgcttttttgccatttgtaggatataataaatattactcactggatgcttactttgtaagtaaaccaacttaaccaatagctctaagaggtaagtattagtcctccaattttacagaggagaaaccaagaatctaaacagttaaataacttgcccaacattattcagcagctaaacagcttgactaggattcaaagccagatctgattccaaaaccttaaatgtctgcaacacaaaccagtttatacttccaaaagccactctcaaagtagtgaccttaggaagagcactgccacagctagaaattttatatctgctttcaaaattgtctttttagcctttgacttattctttaaaatattctctttatcttctcaggtggattgatttggggaaacaataggcagatgtcattctgagccaaataatgaaaatagtaatttgagtgatcacattgatcattgatctaatggatctaatgtgagggcaggtgtgagtttagttgtgaattgagtgtaaaaactattcaaaacagatatttccaaaaatgttttcagataaaatatctatttttagacaagtttatactttcccaggatgatgacattgaaggagattcatctgaatgtgtcatttctagtggttgggcttttgttaagttaacctcattactttgcagtctttcttcatcctaaatagatccatcacttaacatgagttttagagcaaatctgttttcctctaaattattgctcaccaatattaagctttctaccaacgtagtgtagtttatgtttctttttctttgatccacaagcaaatacagaaaagagctatatacagtcctgatagacttatcaaagctcaagctataacctggaaacataaacaaagcttatgataggccaggtgcagtggcttacacctgtaatcccaacactttgggaagccggggcaggaggatcgcttgaagcccggagttccagaaaagtctggccaacatagtggaaatcccatctcagaaaaaataaaaagaaaaaatcacgtggtaaaataacaggagaagactaagcagtgtctgaatcaaaatatttctttttttaaaataagtgaccagccagagagacaccaaacccagttggcctatgacagattaatcagaaccaaagaacaggtgccatacatatgcaacagagaagaagaaaaaaatggctctgatgctaccgaaaatggacacttagacatgtcattttcttctatgggacctgtttccttaactgtaatattagaagtttgaaatagatgtctttcccagtagaatgaggataggtattttggtttggtttgtgagctgctatacccccaagcatctttgcaggtgctaataaacatctgttaaataaatctctaaattccctctagatttggcatttaactgtgaaatacatcagtttcttcagaatgctcctaacctgcagaaccagtttcagagagtttaacactctgggtaacccttcatatacttgagaatgccacccaaatcacataagacccctcattattaactttcaaagctttgagaaaacctttccaccaagtccggtaccaagcatggttaccactgctctgaggcttaccatagggctgtctgagggaatggtaaacagtcactccatagggcctcagggaagcctggtagtacacttgtgggttggtctctgtgaacttgtttgccttcagcacggccatctttgtccaatctgtaaagaacacctgaccttcaaataagcttactccaaagggatgaggaatgagggagcctccatgaactacagtcttcctgttataaaagacacatatatatcatacaatttgttagttttgctttattataattaaagctgtagttagttcaattaaatgcctgaaaagctaaataatttcttgtcacaaatacggaatagatagaaaagatacattttagatgtatacatatttccatctacatatgatagaaggattttcatgttgtctcttggaaaagacccttgagacttacattccagtcccagtcaatcctttagcttgtcctagacttttttggaatttactgtttccccttttgttcttcattccttttaggttgccccacatctaaaaggctaagatgtgaaatagcattttgaataccataagtgaaagagtataccaagactttggaagtctgggaaaagatgcctttgccaactatttcccactgcaccattgagcatttcctagcaattagggagcaggacagtgagtggtagggttcaagccccagcaaacgcccacatctgttcctgatgtcactgtaaggaaagcaagaagcaatgccactaccactcttatgcatctgcttgatggaactatcaactgatcatacttgtaatggaggcccaaagccacttaactgggaagaaaacagaagtaaaattaggcactaagcgaagagaggaaatcaacaacgccccccgtgactatgtctccataaacaatgattcagttagactcatgaacagagtgaggcagaggacggttgatatgggaaaactcttattttctttattttggcgtaatacaaagacctcaaagaaaaatcttagcatcccctgaaaactaaaaaggacaatagagctctaagaaaagacttgaagatattaaagctgggaaacacactaaaggggagtaaacaaagaaacctaaggtggcaggttagtgcacactttgaaacattctataatgacatggtacattaagattagagaatagtttctctctcagttagcaaattccaaaaccctgaatgccacctgctggcaaagcgagaggcaatgactttatgatttcagctgtacttgtgagctttaatatttctttgatgtttcttcacagccagcaaaccactcaaatctttttgaaattccattgatttttatcttttatgctttacttttttttacttcagcaaaagttagactatataatataatgctaaaacatcccaaagagaaaaaatttaagcaatttcacaattattttatgtgacttattgggttagctaattttttcataaaatttattcatattctccttatggaagccagtttcagtgataggaagtcaccatattaatacacaatacttcatttaaccaagcagagattgtcccaaggatatataatccaatggcaaactgtgatattatccttacaaaatggaaatacaagaggaaacaaaactataatattgctttcattgagaaaacaataaaatcaagtcattgggaaaaattaagttaaccagcctatttgctgaatccacaaagaataatattttgggtcaaaatttgaagaacatgttttacccaatttttgaaaataccaaaaggagaggatctaaaataattttttttacattaagttgtagttagctctaatcagagtaaaaagatgaaaaaaaatatgccatattcagccaggtgtagtggctcacatctgtaatcccaatactttgggaggctgaggcaggcgaataacttgaggttaggagtttgggaccagcctgggaaacacggtgaaattttatctctactaaaaatacaaaaattgccaggcatggtggtgtatgcttgtaatcctagctactggggaggttgaagcaggagaatcacttgaacttgggaggtggagtttgcagtgaaccgagattgcatcactgcacttcagcctgggtgacagagtgagactccatctcaaaaaaaaaaaaaaaaaaagaaagccatattctacattcaaatattgctgtttaagtatctttgtataccaggtaaaaatacaatacaaagaatttctccttgaaatttgaaatatataagagcagagtaaaatccaattaattcccagtaggcaacatcaaatacctaataaaacatgtatttattgggggaaggttagaaaattaaaagggaaagtgatcttgagaaacaaagcacaaatgaactcaggagtgaatgaaaataatgtgcatcatgtgggactaggggaagagttggagaggagaaatcaaagaacaaatgctggaggttatatttaatgagcgtttacctcttgtgttatgggacacaagaaaagttaacaaaatagagcaggtcacttcatgcaaatgtcagtacaaaggtcattaaagctatcatgtccaccaacaaagcaatattttaattctggtcctttgatatttctctgcagccattttatgcactttccctgcaacttataaagccataagccataaaaaatacttcttacctttgaattccatcataagttacagtttcaatgtaatcaaaccgagagtcaacccagtaaacacgcttcgatatcatatccagagttaccccagcaggccatcccagctttgttttcaccaagtctttacggttgctgccatccatgaatgccctttccagcttaggttccccagaaaggctctcccaatctgagaaaaataaataactacaaaagaaaaacagaagatgaaagaatctggtattttacaagttaacctgggaattttttttaacagtgtgtttggatcaatggaaattttatccagctgattagagaaccacagtataaaacaacagggaaattaagttgttttttttttttaaagagactgtgggggtcagtcaggagcatcaacagttccaaatagcaactattatgatgcactaatatggcagtctaaaagttcatattcagccagccaggcacagtggttcatgcctgtggtcctagcactttgggaggccaacatagaaggattgcttgaggcccatgtttcaagaccagcctgggcaacatggcaagaccccatctctacaaaaattaaaagattagctgggcatgatggcacttgcccatagtctcagctactcaggaagctgaggtgggaggattgcttgagcccagaagttcaagtctgcggcacgctgtgattgtgctgctgcactccagcctgggcaacagagcaagaacctgtctcaaaaaaaaaaaattcatattcaccttctgaactttctcctctgtttcctttatttgtcctttgcttctcttttttacacccaggaaaacttacaaataccttttaaaagaagctatcaagccattttgctcctcagttttccattctgaggcacagagaacatttccgtcattttcaaggaaggatagctgatataatgaagtagaactgaataatcatcattcacaaagactaaaatagcctaaagcttatccaagggtcctaagacccaattgtgaaattctaggagaaagctaagtctcctataacacttctcaaatgtgaagattgggaaatttaaatttaaacctgaagaaaagcattatcggtgttgctggattgattcagactgaacaacttgtaatgagatattagcattgatatctcaatcccagcctgtatcaagaaagttctgaaaggaatagttccaacctccatctttaaaaatctttacagctaattcatgttagagtaatcatcttaataataatgaagcataagtgatgtttagttgtaataatattattagattgagttagaacacaaaatccaatctcttagctaggaaaacgtggcaaacactaagaataaaattcatagccccaaaacaacaagtatttttagtacaccactaggtgtgtttgggtaacatgtcctcaaataggattatatttaataaactctcttaaagcttctataaataagggcacaaaatagacatggcttctagagtatacagcctaaaagaaatcagaatgagcctttgattaatccagtagatgttcagtgtatagagggagagagaaaattctaaaaatacaggaatcaatatgttttcacatcacttacccaacagttgggtccacggcaattcctctaggatgccccaagttttcagttataagggtaacccgatagcttccatccaaatttaccatatctatgcggttgaccttggtttccactagatagattttattattaacccagtccacagccaggttctctggggtttcaacagaaacattgagaacctcttggatatttaaaccattaatgtcaactgaaaaaacctgaaagaaaaaccaaaattattatatttcttcagcatcactaactacgtggtttgttttgattttttttagctataatcaaatcagaagtgctaaaaatctaaattctcaattttcagaaatttcatgcaagttatcatttaaataaatgagaatcgtattaatggtataataaaatgtaagaagaaataaataaaattccataactctttaagagtttctgaaatttatgtttcaaaaatctccattgcattactccaagatgaaattaaacccatcacactttccaaataagacagtgaaacaaaatttgggccattaaacaaaataccgtcaatatttgttactcgatcccgaattacagttccatttagaagatgcaggtaaaaatctgatttttatcatccagaaaagcagtgtgctttttacattttaaatgatcaaatttcaaaaattactaccaaatatctatccagttttgaaagaatgtctactatttcttttaattaggctcctggactccacttcgaataaaattaaaagttgctcaaggctaatccatataatagactgctttgtttaataggtcacatgtaatagtatagcatggaaaaggtgctgattaacataaaatatctcaagggccttttttgttagaaaacaaaggaactttcccctctactccctctaaaagtgaaaagctatcaacactttgtgctcagggttccattcagctactgaaatttctatttaccttattttgcacggtgtctgtccaaaaaactctttgcaggtgatagtggaaagccacacccacggccactccacgattctgagactccactaggatccggaagctccttccatgaatatcaccaattaacaaatcccgaccattggagaagataatggaggcctcgccaactaaatgcgaagaaggaaggcatcaccactccttcagatgagcaaggatggtgaagtagcttacaaatgatatgctttctgctttttcaaatgctatcttctaggttgtcttacctgattttaacataaacctctgaggcagacagatagctagcattctatccattttacagaagggcaaattgaggcacaaaaaggcttaatgaagcgtccaaaatctcagtaagttaggaagaatttggtaagaattcaagcattctggatgctagtccaatgcactttcaatgacactgaggagagtatttctcagatattttcgagactccttgatggtatgggcaccttagccccatgtgcaactttagattttgttaaacacagaagacattttaaagattaccaggaaatcactctgaaaaagatggtaatggtggttccaaatctgttctgtctgtttactcgcaggtatgcaaaatgatatatgaacaaggtattaattgcagtcttattggcaatagcaaaagataaggaatgatataaaaattgatcagtagaggactagttaaacaaattatgaacataaaagaaggaatattatgccattataaaaaaataattaaggccaggcgcagtggctcacacctgtaatcccagcactttgagggactgaggtaggcagatcacctgaagtcaggagttcgagatcagcctggccaacatggggaaaccctgtttctaccaaaaatacaaaaattagctgggcatggtggcgggggcctgtaatctcagctactcaggaggctgaggcaggagaatcgcttgaacccgagaggcggagattgcagtgaggcaagatcttgccattgcactccagcctgggcaacaagagcaagactccatctcaaaaataaataaataaggccggatgcggtggttcatgcctgtaatcccagcactttgggaggccaaggcaggtaaattatgaggtcaggagatcaagaccatcctggctaacatgatgaaaccccgtctctactaaaaatacaaaaattagctgggtgtggtggcagaagcctgtagtcccagctactcgggaggctgaggcagagaattgcctgaacccgggaggcggaggttgcagtgagccaagatggcgccactgcactccagcctgggcaacagagcgagactcattctcaaaaataaataaataaaaataaataaataaataaataaaataattaagaaataacttcatgtgctgaaatggaaagctctggaaaatatcttcagtacattcacaagatgcagaactgtgcatatagtttactaccatatatagatatgtaaatacagttaaatatctatatttgtatgttcttgtttattcattaaaaaatctctagaactaaaataaagaaacggcaattactcataggaaagagaaggtgaaaaccatgcagaggggaatagttatggaggaaggcatttcactacatatcttcttataatttaaaatttgtgaacatataaatatgttacctatgcaaaaataaacacattgaattgttaaaaatccgctgaacctaaaagttactacacagcaaatcaggtatttctacacaaaaacaagtagaaaatgggccattcttcagtcatgggagcagttaagtttcagaagacaccaaagacacttcaaaatcaagtgttaaataactattggaaaataggagtttatattgagaccttcgtccggagaaatcaacagcgacaaaatgctttggagccctcatctattttttgcagattttctccatgacttttctctactactctgtactactctctacttttcatactcttacactgattccaacaaattacccagagttagtgcattcaaaaaattgttaatccaaatttagcatgtccatttggaaatatccctaaattttgcaagaacactgtgaaaattatttctgtagatagttgtcgcctacttttgtggtaggtaattaattaaaagttaaatgtccaagccaatcaaatgtaggcatagcatttattccacaattaaaggtgggtgacatgatagcctaggcaaagtaaacaatcaatcaattaaaaaatattaataatggtcaccattagtcgacaaattggtccttaataatcaaagtatgaaattaatgttgaccaatttttctaggcagtaggagccatccctgatttgtaatgataaagccctgccaacaacaaaaatgctgataattctgttgtcatcagaaggaaggaaagaagctattagaatctgttcactgttcagagacacaggtgtccataatttactcacaggaatcattagctttgcaatactgtccacgctccaagatatacccttcttcacagtggcacaggtgacggccaggtcggctttcacacttctggtcacaaattccccatatctggcaatcatcaaactctgccatatggaaaatacacatttgtagtcaaggttatcagcatttattaagcactctctgacaaaaatcctagataagatggccaagaatgtggtgttgcccatgtctaaataaacaccctctggaattaggcacaggttctgagaatttataacaaccatcttcatgtaaggaaaaagaacatttacatcattttttaaacctacatgaaggataactttacagaaaatgcacaacacttcctgaattcatagccctatggtactgcatttcatttattaatgttagtctacaaatatataaattttggtgtaaatgtttcccttcaatactatgctttccaacatggcagccactaaccccctgtggctatctaaatgtatctttagattaattaaaataaaataaaattaataatttgctttcctagtcacttgccacatttcaagtgctcaatagccacatatgactagtggttacaatatgacagagtgaagatacacatttacatcactgcagaaagttctattggacagcactatttctgaataaagtaagacctgcctatagacagcccctcaggaagaaacaaatctatgactgcaataaagtacttggaaaggtctatttacccagctgtctttcctctgatgtcaaaaaattataaccaaaattaaattgaacttattttcaagacatcaaaaatgtcttctcctctacttattggttaacttattattcactcatttagtaagtgttcattgaagtcccttacatgacagagctctgttcattaccagagaagtcccagttctactgtttaaaaatagttccaatataattgacataaacaatagaatatggaggggagaacacaacaaaatattagaagagtctttcttaaagactataaggcttcaggggtgcagaaattggtacatctgactttccaagtccacgtccactctccatcatccttcaccctcctcgcttccctgggaggatgacctatacaaactataacaatagagttcccacaccctctggtttcaggaagttctcaagtagattataatttctgaaaccactgcactcccaagtctagaattctccagatttctatgatctgattacatttgcagcaactgtcagagttgtgaattgggttcaaccattcctgctgggtggcccaccattccataacccaccaaaaggccaagtttcttctcttttcttttctttttcttttttttcttttttttttttttttttttttttttgagatggagtcacagtctgttgcccaggctggagtgcagtggcacagtctcggctcactgcaacctccgcctcccgggttcaagtgatccttccacctcagcctaccgagtagctggaactacaggtgtgcgccaccacacctggctaatatttttgtatttttagtagagacggcatttccccatgttggccaggctggtctcaaactcctgatctcaagtaagcagcttgccttggcctcccaaagtgatgggactgcaggcgtaagccaccgcatccagccccaagaaggctcttctaatgatcccattttccctgcagattaaacataacaacatgagccagcatatctttctttccaaggaccgtgactaaccagaggaaaaaaaacccaatccgatctggacactaccaagtgaaatgccacatgagggtgtgaaatgccctcactgatgaatcccttctgtccccttaactcagccctgagaaagctccacctaaggctttgcctcagcaggaaaaaaagtacaggacattctccctcaaacccccagaatgtcataacttcattttgaatgcaagatccatgagaccacgtctaaggatctggagtcactctaagcagaagttctgatgtcaaacagaaggaaaccaaaggtggagaagtcataactaggaattctctagcacaaatgcccttcctatcacctgcactacaagtggtttaaagatttgaatgagtgggccaggcacagtggctcacgcctataatcccagcactttgggagggtaaggtgggaggattgcttgagtccaagggtttgagactagcctgggcaatatggcaagggtttatgtgtactaagaattaaaaaaaaaaaaaaaaaaattagccaggcatggaggcacgtgcctgtagtcccagctattcgggaggctgaagtgggaggctgcagtgagcgtgataatgccactgcactccagcctgggcgacagtgagaccctatcacaaaaaaacaggatttgaatgagtgtataaaattgctgtcacttttgtgacaataagattgtatccttggatcactatagaggaatatgaaggttaattaacatccatcagcagccagagtgaagacaagaaaaataaaagtagaattgagggttttcgtgagagtagaaaagatagtggaaaccacacaaaacactaaaacactactttacaatccccctctcactccaatacctttatctatttttctttcctttttattctttgtctcctcccaccaacaaatactgctgtgaaaatgactcaaaaacccctttttaactgagccccccttggccaccctctgatccatctggctgtgtgaaaccccaccatgctgaatgacctccctgccctcactctgcaccacgatgtcattctgtcaacaaacagcatgtcctgtcaatcagaaacaatgagcccagtaaactgcttcagcatgcctcagagcttccactgccaggtcaacactaccagaggcagatgaatggtagaaagacacaagatttcgtgtcaggattattcaatgttattcttgattaccaccgaggtattcactggggagccatgtctaagataataaatgttgcataggtttccaacacctgaagcctgtgtaatgcgtcagccatgcagagggttatagccatacagagagtatttgttgaaatgaaatgcttgagagagcaaaccaaagcaacaattcccctaaaaattcagctcagctgaaacaagtgtaactggtttcctaacgtcatgtatttaaagagttctctataaagagagaaaaatacagtcttctttgaaacaaatgtgaaataaatgttaacccagcctcaaaactcagaggcaaatgacacattcttgaaggacagcaaaggtcacagaaaaggtctctgcaggtggcaggaggcctcatattcacaaaggccctcaaatgtagacttttgagattatctccaaatgaggttgtctgtactaaagtcccagaaacgcgctggcgggaatgaaagaagatgtctgttgtggaacttaaaattagtgccccggtattagaacacactacttccaatgtgttattaattgtggtatcttctctgatcctgaaattatcctgtgcacacataatactgcaatattctgccttacattcactagtaggttaaatgcaaaattttataaaacaagaacattgttatgacagcctttcgctttgtgagaggctattgaaaattgaagtggcctgaatctctgacatttagaaaaccctagacatttggaaatacaacccaaggctcaccacagacttatatgttggaaaatatggaaaatgtgttatctgggctctagggtggaacaaaaaactgagaacagcttgtggggcatcacaagactgaattagcgattctgaaagaacaaatcacttttcctgaaaggacttcatggcctatcaagtttcaactgtaagacagctcagccccaactcctctttgggagttgataaaggaaaaagagagaaaagctgatgtaatactgagaatgtggcttctggtatttctattggaacttcttttctactaagagaaaaggaaaatgcctaaagaactaaaaggctgggaatgggattggcagctgggtagcagtgaggggggaaaaggagcctgacatttgctaaagacacaggagtggcctcacacccacagacgagccccactctgagcagaagtgaggctgcccctttgcgcagggctgcctgaaatccaggcagggctcccagagtcaggtcaccacctaaccaataagggcattcgtgtgaaaagtatctgtaaattacttgaatgcattcccaatataatggtaatgataacaataaaacacaaaatgtgtcctgcaatcttatttaagtccagttgcagatcataacttttatttataaaatgttttaaaatgattagaaatttgggggccttcttaaattattccagagttcacttaagtcacttgatcttaaagtaccttgttgaatatagttacttaagaggagcaattagatgggcaactttgggacgtggtcctgatattaagaacctacagttacccactatgaacacaaggaaaagctcaaatggattgctttactggatataaaaatctaattttttttggcatatggtaggtaagtgagcccaacgattgtagttttcagtaacgctgaggagcagactttctcaagaatttcaagtttaatttgcaaaccagagtttatttctggtatcaatacatttttctgtttgctagcacttccgctgaagaataataataataataataataaagaaaaaaagaaaggcttttctggctatgagtagttgttaagattagctgtatttgacaaagtataattatgttggaagcaatgagctgagactaaagactgaataactgcattaggtttatctatattcaataattttttccaaatgttaccaaatagttctaaaatattaaaattttaatattttaatattaaaattttaatattttaataatattaaaataataatttcagaagaaatacttttctagaagcatttcttacacatttcatgtttgttgctatcccaaaagccctaaagaatacctcacatttctaaggaatatcaaaagaatataaatatcctgggaaaattctgaatcattttggagccccatagatgactaccaaattttaatgaatagtttcaattgccttccagatgccttttcccaacagcagtaaaaatagttttctttaaactccctctgtgatcacttcctgctagtatgtttgttgttcatgtatcaaaaatcagatagaaggaaaaaagatcagagcaccaaaaactcactgagaaaacaaaaactgatgatagttggtcaagtctaattctcccatcataaggccccgtcctaatcacagtgagatataaagctggcatcaaaatcaaaaatctcattgggagaaatcatttctgaagtcagagaggagagatatgaggaaatagttggtgtactggtgtctagtttaatgccagccaccatctggaagcaccatgataaagaatctgctcatcttgaatgatagttccaagtggatgtcacaatcagtggaatgagtagccagcccagcaaaggcactggcccaccagtgtagtcacctgagcaatgacctggtgatcctctgctgtgtcaggtaacaactctttagttgtgggatcctggggatgcttgtgcatcctggagaagaggccaggggagcaaggtagcggtgcttgctgggctcaggcagcagctatctaccaacctcatggaagtagttcagtattcaataaccagtatggctgcaccaatcctgatgccaaatacttgaaaagaaaacagaaaaggactaccgccctcatcaagtaatggataggttccaggtagctagtcaactcgctcatgacagaaccattcttttgccttgtacaccacaccaaaccttctcagagttaaaattccctatttgccaggttttctgtgaggtctgggttgctctttgttatgacagaccatgacgactctccacaagtgcaacctcctagatgtcagagatcagggcacccatcagtgtactgtaatgaaagacaagtagccgccgccccccatcacttaccaacacaggtacggctgtcattgtggttgatgatataacctgggggacaaaaacacgctcctccatacggcgtctcatggcactggtactggcagttcaaggcagagcacagagtcatacctaaacgaagaaaagaactttgttaaatgaatggtgacctctggacaagactgattaatctaatagcttctttttccatgagtagcagctcagtaagcatgaagtagatgtacagaaaaatctgtcacccttcaaagcttactgcaaaactttgcaataaaagttcaactgagacaggaagattgcttgaagccaggagatcaagaccagcctgggtaatgtagctacacctcatattcacaaaaaattaaaaataaaagcattagccaggcacagtggctcacaactgtaatctcagcactttgggaggccaaggcaggaggatcacttgagcccaaaagatggaggctgcagtgagctatgactgcaccactgcactctagcctgggtgacagaacaagaggctgccttgagtggaaacaaaagaaaagaaaaagctcctttttaaagttataactatgtgcaagtataagtcattaaaagtcttatttatgaaaaaaaaatcaggtcatgcatgggtctatctttgtgtctacatagtaaaaagggctaagaactcccaagtgactggagcaagaataagccctagaaatattaactgtggctggcttcaagagatgggatttcaggtgattatatttttttcttttggttaatttttattttccaactttcatactgtgactacatatctcttattaatttttaagcttttttaaatgggctcccaaatgaaatagagaaaaaaatgccatagaggtctctgcctgtttaaatattatgtacaatttttgtcaggaaacaaaaaataaccttggggttgcagttacatgggcacttctaggcaatcacaaatttagttagagtatattattgatgaaatcaaggttttaaatggcatttccttacaggaccatcagctgtccacagagttgatgggttgttggtggggtgaatattctacagccccaaaaaaggagaaaaaaaatccctagttccagtcagtttcctcataaatgaatgtggtcacacaagacataatcgaacaacactgtgcatggccaactcagttttgccattggagagtaactcaaggtacataacccaggaaccagaagctttttttttttttttttttttttttttttagtacagccagacaaggcctttttccataagtataagccaggtaataaaatctccagaacatctttaaggtcatcaaaattgccattgaaacaatcctccctgtgtgtgcgttagggattaggaacggggagttgctaaaaaattgttaggctcttcccatcaatagatggagtctatttcttccatccactctgggtttggccaagtgtcttgctttggacaataagacttgagcaaacttggcataagtagaaccttgaaagtacttgagccctaggatttgctctttcagcctctgggtcaacaaggctaggctagcccaagcttttactgcaacatcctgacgtgtgagtgagctgatacaggccagaggaactacctagccaacccacagaactgtgagaaataagacacgtttctcagtttatgccactaagtcttggggtgctttgttatgcaaatgccaacagatacactgtatttgaacgtctgttctagaaaacagaaatatctttatctgaaagctacccaggtaaatgtctatactcactacagtattttccggtactagtgttgttttcatcttctcttcctgggcaatctaaaatcccatcacaaactttataaatggagatgcatcgtcccgactctgggcaagaccattctcttggggaacatttatgaacatcatgaggaccgctttctgtggggggaaaaagagagagttacaggccataggggaggtacagccagctctttgttaatcagtggtttacagaggatgtagagcaagttgaacaagagaaatctataaatgatctacattttacaataagttagtgatttctaactctaccactagtcttttactgagattctaaggagaggcataatggaattactccacttttcctggaaaaggcagcccccagtagggttataagaggaagaagcagatatgggcctcaattatcgacaaactaaattcatgatcccctaagaaaagatgtagttatttaaatcatgaattatagaattagggccatcaagttaggtccagaattacttgaatttgtggttgggctttttgatttgctttgtttatttagtgaaatgtcaacagtataagaaaaaccataacccaaatgtagaaaaaccactttctggaacataaaaacataaaacatagttttaacaagcatttcccttatcatacctgggattggaatggtgcaggtaacttgctgtagggtatgggtattagtaactgctaaattgttggaggtactgctgatgatatcagcaacataaaagggtcaatatcagcaacataaaagggtgaatatcactggcaatttccttctcacggaatctttaagcacttccctggatagtagcttctcctacacttaccatccccagctccaacccacgtgttcccaaggtggcctctctttcaccactgagtgtcagtgactcatttgggaatcagaatttacaaaaccaaaacaaaaaaataagctgaactgttaccaaggttcaaagtcatttttaaagattgtaaggtctaagacaaatgacattttccctattttctttccttccccagcctattagttttatatagttttaaatctatttaaaacaggcagtcttacagggagaaagtcagactggggtatagaagagacagagactgtcctacctattttgccttaaagatagaagggagaggattataatttaatctgtatttgtgttctgaatcttcttaggagaagttagcgcagtcacctccgtcttccccacccactaagttcctaaacaaccccttcaactccagccaatcctgaggcttgcttgtcacacaaaatttctaaaaaggaaaggagaaaaaacaagcgctggaaaacacttgaagaaaatgcttttcagtaggaatctcttcccctccttaccacatccatcttcatctccattatctttacagtcatcttctccatcacaaacccagttttgataaatgcatcggccactggggcaagtgaactggtaaccaccgcaggtcggatagtctggaataaagcaacagctgcactccaaagacacaaatcaccgggaaaaactgaaagtgctctcacctcactgcctaagcagtactcctagaaattgaaatttctatatcaatttaatcccttagacatcttgacaaaaatttttaaaaaggaggaaaaaaaagagagagaaagaagaagataacagcagctttgggtccaggaaatgaactcaggtgccggtttctgtttttcaagattaaaaattagatcagcctgggcaacatggtgagacctcatctctaccaaaaatacgaaaaataaaaataaatagccaagcatggtggtacatgtctgtagtctcagctactcaggaggctgaggtgggaggatggcatgagcctggtgggggtgtgtggagttgcagtgagccaagatcgcaccactgcactccagcctgggtgacagagtgagaccctgtctcaaaaaaaaaaaaaaaaaaaaaaaaaattaaaaacaagatggtttgcaatgcgttggcacagaacagaaaatgcagacaaagatgctgcagacatgacaacatccaacgttctcatactttactacaagctccgtaattgctaatctatgaccaaatgattctgagtcgaccattccatgatgtcacattctctttaattctctgtcactgaaataagcccaggttccagaaaggaagtcaggcatggctcattgaaaattagggtgatatcgaaaatatttaacaacaccctaaggcatgggtaccaaccaatcaaaagaggtgtggagggaaatcatacattctagtaaataaatcaccacgcaaagctgccaacttactgaacatagtaaaactctttcacagagtcttctaactttactctttccaaaaaacataagtggagaggtggcaacaataagagaggtcatttgcattgcaggcaacagcatggacataaaagcaaggtcagcgtgaagaagtggaggcaagaaagccacctataccacactgaaactttcaggctgggcgtggtggctcatacccataataccagcactttgggaggccgaggcgggcggatcacttgagatcaggagttcgagaccagcctggccaacacggtgaaaccccatctctactaaaaacacaaaattagccagacatggtggtgcatgcctgtgatcccagctattcgggaggctgaagcaggagaactgcttgaacccaggaggcggaagtggcagtaagccgagatcgcgccactgtactccagcccaggcaacaaagcaaaactccatctccaaaaaaagaaaacgaagaaaaagaaactttcctgaccctccaactttaatgcagcagaaatttcaaagtaaagaggagagttagagccactcctaggaacttcctttcccttaaaaacacttctctcattctactatcaaggttgtcagaggtatgggtcatttgagaatccagtgatacaatatatcctgtacccctggagcctaaggaaagaaggcaaactgtccatcaccagccctttacatctacacagatccttggaaaataaaggagcccaggtcgagcaacaccacaaaggcttgtgccaagaccccctagtgaccgtctgattccatctgccatcaaacgtagtgactcttctccttgaaaaaagaggtacattggtgggggagcggggggataaaacaaaacaaaaccgaaacaaaacaaaacactcccaacaacatgacccagcataaagaaatcaccgtactgcaagcatgttcgtcactgccgtcttggcaatcattgtcatggtcacagacataagcacgagggatacactctccattgccacatgaaaactcattgtgcaagcatatctcagctgcaacagaaagttaagaagggaaagaaaagagagaagttaactccattgtagccatttaatctcaaaggaagagcatctccagtttaaaaagggattcttattaagcagtggtgtgctggtaactgtttaagaaccagttatccaggaacaaaaaggccctggtttgtagtgtttgccgatttccagtgtgtaaatactcctaccaacggctgacttcaaactaccaacatgaattcactgaacctgaacttgggaagagatgtacatattggctctctcaaaccagtataaaccagcttcagcacacaactgcacatcttgtgcacaatacttactgcagttgatttcatctgaggagtccctgcaatcaactttccaatcacacttctgactggtgttatagcaggccccattgtcacaagtaagctgctcacatgttgggtactctattgtaaaaaaaaaaaaaaaaaaaaaaaggaaaaggaaacagtaaacaaaccttaaatttccttcagcaaacatttattgagtgattactatatgcaagtcactaaatgcatatattgatacacaaaagaagtatgctccctggcttcatggagagtaaggctggacatgggagacagacattaatcaaataagacacaaatggtaaattacaaactgggataagtgctaatgtggaaagtacagaggactgtgagactgcatagcagagagatttgggggcccagaaaagtatcccctgaagaagtgacttttgagccaaaagatgaagaatgagaaagaatttaactttagttcaaaatcaaacattcttttacatgatacagataacatcccaggaaactaaagtaccactgcacaagcttggaaaaaagaaaggccatttcttccactggcgggttgcagaaagaaagcaggcctagagttcaggagccctggcggcccagaggtaccactaagcagctatttactgtgactcaagcttcatgtcctctccatgttgctacttccctatctgcacatttggataacctactgcacagggtagagcggcctgaaaagaccatgtctggtaaagcatgttgaaaagcataatgtgctttcaaagcacaaattgttgttgccacgttatgtacatatgaccacctcactgctactcactggacctggttttctaggtcacagttgaaaatcaggaagtcccttacaggaataacgtgctatctgtccctcctctctacttgccagacttggaccacctgtctctcatgacttcttactggaggctttattctgtggatggttgatctctttccgccatgacataatgaaactccctgagatcaaggatcctgtcttactcattttagaatccccaacaattagtacaggggtgggacatttctcactgtgcacacttagtacaggggtgggacattactctctgtgcttgagaaatgttcaatgttgctattatttatcacaggtgaacattttagttcattcggctttttaaaatattttgaagttctgccttttatggcctttgaataccctccttttcacaaatgtggatatcttccttggtctgaccatcttcttcatgaaagattatttttgtagtgattatcaggtcatcttctgatttctttttaaccaaggaaaaggtatgtcttaattgactttgagtctcaattttgcacttaagaacccaatttgagattttatagagatataaatatattgaagataattctttggatagtcccaagtcttttcaagcagaagccatgcacaaaattctgtgctgaaactgtactaaacttgtgccatgttaacaacttgcactttttaaaaaaatggactctccaatgatcttttttttggtatagtaaaggaataagcctaactcttctcatctccagaggttcaaagctagtttattaagtgtccttaaatatctcaattgccagagttacatatagtcaatcatatgttaaaatggaaggcatttttaaatagctggttaaaatttaaaattttttctgaattttattttgttttttaatagtccaaaagtgagccagtgcctagagttattgcgtctttcctcgctgagatgatatgccttacaaatgtgccttcaaatgagtcacacaactctcccttcaagtgatgtttattaattctcccttcaagagatgcaaaagaccaggtgaggtcagcaagcaattcctttgcccctgtgagccagatagctcctagagtcaatgtgttatctagccttttaagagcagcagcaagcagaagaaaaactcgtagaaaacccagctctttgcaatagataagctatctgtctggaggaaaattaatctgggcttgaacggtggctacttcatttaaggtgataattataaatataaagaatctggaataagtgtgctggatggatctctcgttttcttcatcctgctttttgagagccagtgccagaaaattgaaaggggaaagattaaaactgtaaccactgacatgactacaagtttactgacaaggcccattccccacccaacaaacaagaagcccagcttgatatcatcagggagggtattgtgatggccagaggtcagcagtttgacttttggaatgaggaacacacagctttcttgtctccatccacactgataaagaatcactctcaatcagcagaggacccctctcaacccctgcacaccttgatctcttcggtgcatagttaacctgggatgtatactcataggaaagattgcacagagctccctaactccaccaaatactgaaaatacctgaaaatctgtttctgaatggttttccctctttggagacccacacagagacaacaggtccaaactgtcaacactgagcaaagaaagaaatgaatggattctactaccattgctaaagatgttaatgagtttcaatctactccagaaaacaataattcacaatcctttgagcttccaactgggagatatctaaagtcttattttttggttcatttgcttggcaagcctaagtctaaccttcttcccacagagcaaatccatcatgtggctataatgtcctgcaagaatttaagtatagggtaaagtgcaatatgagaggagaccatatataagaacaccaaggaaactcttccttctgaatttggttttaatggaaagatcaacaagtagctataaattaagcctcagacctttaaggttttttctaacacaaaaaggtgagaatatccttcctcataccactccttgcttcccctttctttactttctcccaatcccaaatgatacatgttcagatttgttcccccataattgggagctgccccaaaattatgcagacaagagtttttatattttttcactgttaatgatttggtttgaagcaagaaatttctatgctatagttctgtttacataatcagggaggagggtgtagaaatgtagtttgaagatcttgtagacctcttagaatggaaatcattttaagcagagtaagatacaaatataaggcactgttcattattatcttgacaggaagactgcagacatgttttattctcacaatttgacaacatggctgaggacaacatagaaaaaaccattattatgaagaaggaatcttaaaagtaggttaggaaacttaagccaagattgggaaacacacacacacacacacacacaagaaattaccgatacaagtccagcccagacacctgggacttttcaaggtcctagagtcatcctttataagttactttatgttatttcctctggctccaagacagattaatccagtcaatgtaatgatttgccagaaagaatctaccagtttggccaccagcacttacttcaagcgctacccacaaagttaaacaagcaatcatcatcatcatcatcatcatcatcatcatcatcatcaataacatgtattaaaaactatgtgccagacatgtgtcaaagtactcaatatgtataaactcatttcatcttcataacaacttcatgaagtaaatactatgatgactcccattttatagagtaagaacctgagcattaagaggttaaggaatttgaaaaaggtcacataactggtaaagttggagagccagaattcaaatccaatcaacctggctccataacccaggttactaaccactaccacagatacatctaccacttataggctgcagagtaagtaacaggaagaagcgaaaaattaaagaagaaagaaattgaatgaaatggtaatagaaaattcttaaaagagattatgaaaagaaaaagaagaaacccaagaggaaggggggaagattttctttctgccagtcagtttcccatccacattaggaagaagggaaaagtgaggccaactctagtttcccacaacttatggcatagttaacaaagtacttcaatatgatataatctaggaattctaggaaacctacacaggaaaaataactttccagaaggagtaccaggacaaacaggagagtcaataccaaaaaacaggccataaagttagtctcatgaaggtaccaccacgactccccaaacccccattcctggtgaatttcaagtccctaaagtgactgccatcatggactagctcttagggaatgcagtaatatacaaggaaaaaaacagagaagcatatccttccccagtccaaaagtaatttgaagaagctttcaataaaaagttatataaaaccagatttattaaaaaagaaattcagaaagaagaaagaaagaaggaaagaaagaaagaaggaaagaaagaaagaaagaaagaaagaaagaaagaaagaaagaaagaaagaaagaaagaaagaaagaaagaaaaaaagaaagaaagaaaaagaaagaaagaaagaaattcagcaccttggaaagagaaagaaaatatggtcatcccgaggacttgtagaattgaactaacatcaagtttagtctgggtggctttcaggaagccaaaggaaaaagagaaataaactaagttatctagttttccttagctcactccctttgtactaactgggtcttaagcctgagattccttgctggtctctatccacagtgacctaatcttagacctcaactagaaatgtgcctgagagggttgctccaaggagtccagatccacagcactgccttcttcccataacagagctatcaccaaaaactgcaaaggagataaaaactgacatagttctaaattccttaaaaaaaaaaaaaactcacacaagctctattacaaaagtgaccgagcaacaagatggaaaaatgtgcatcaaatgctccaaggaatagtacaaagaagtaagatgccttctaaggggtaaacaaatgtttataatgtacatcatgtttagtggcacggggctacatgttttcattgaaagccagacaacaccatggtttcatactttagtagttattcccagggacccacctgggcagaacaaaagacaaaatctaatcaaagagacaggaaaactagctgcaccccagcattataagagtagccactttccaatcactagaaatggtgtggctcagcctccctgctggaaatgtagccccaaataatttgaatactcatcagcaaatcattgctggatgaatgtcaatatcctagaaaccagttattctacagagtgctgccttcttcttaattagaattctcttgtgctcaacatgtatttattgaaatctgacttcatagatactgtgctaagaattaaattaaaaggtaaacaaaattacaagtgaagtagcaattcccacagcattttattaatcaatccatacaaaaataattattgcacacctatagtgtgcaaggtactaaagaatgaaataaaatcccatttctcatggaacagacattctatttgggagagtgaaattacagctattaaagtaaatgtcacaatgggaaaaaaaacttgcaaaaatagagctgggtaaaaggtaaagagtaactgtggggagtagctctctgagaagtgatatttgaacaagaaccattaggcttagcataatggcagtcattggtagcattgaaagaatattttcaggagattggtgaagatgaaggactattttcagtgggttctaaaaaaaggacaatcagttggatatatcacatatgtaaaaaaaatttttttaaagaaagaaacaggacgagggtaaacggaaacagccattaacgttaatgctaggaaactctgttgtaaaagggagcagagtaattggcaacagctaagagggatcttaggatctttttaaagatgggggatatttataacatccttgtatgatggaaactaaataaaagagagttttctttccttcctccaggtttcagggctctgaatcctatctcaattgtgagaatgctaaaaaggtacatctgtgatgtgacaggtaagatggggtcctttggagagtcgcctgcttcttctttctggcttcagggagagagagaatagcaagggcaaggctcgctgggcagcttaaatgtggaactgagtttgaagaacatgttcttcatgcaccctcacagtccacaaaatgactttaaccatctttttattcccctcccactgttccctcagctggagtttcagcagttaaagatataaagaaaaatgtttaaattctaaagagcagaaagtcaatagaaataaaacttctgggacaaagcagccccagttgcaggcagaccaagtactgctgattaccagcaagaaagccttcattgtaacagggattttaccctttctttggcattcctaagtaacaaaagagaagtgctgcaaaccaacgataattagcaatagttttattcacaccaaaatcattctaatatggtgcttgaaaaagcaaaataatcttttcacttaacagaaaaaaactgtactatttttgagcaactgaaagtcacgtcaatatattaattgaatgacctataattgctgcattgttctgatgtttatcttagaccctgcatgagtggtttttccttgatgctaatcccattagaagtaaaatggaccgcagttttgaatctctctgttccttaaaaaaaaaaaaaagttaattgacaagctgtttaatatgagatgccattttacagatgaccagattgaataataaaagaactaagggggaaaatgagcttttacctgtttcacaggttttaatatatatatattcaaaaatttttctaaaagggtaaaataaccaccaataccttatgcatataaagatgaagcagataaaaagaccaaacgcaataagaatctctcatactataccacatttatctcaaaaataatctttttgttgagaccctaatatcctccccttcctcaccatctcgaacattctctcacctcctctctccctgcctgcctccctgagaggactcttacacaccactctttgttctgtaaaggaatgcccggaatggacacaaggtactctgtcttggagctcagtgtcttgattttagaagcttgaaagggtatgaactacaacctaggggtctggaatgacaggcagggctacaaactacaacatcaagctccctaatccttttgaatattagagggaagaattgagcccttctttggagcttttccaacatccattactatttttaggtggtttccaggtacctaatatattcattcctataggccattctatttctgagaaatagaaaaacaaaagccccattcacaggctaattctaagtttgtccacaagtaatgatttccatgcatcgtcactgcagaaataataaagtgtcatgtctcatgaagatgatttctggctaagcctcatttaatctttgatcacatgaaaacattctaatttaaagcaactaataacagctgttatatatctaatgcaacatttaaaataactaagtactgctatgactaaatggatttcagcaatgatcatcaatggctactcacatcacagacagctagctatcctgtgtctcctaatgaaaatacacagatttatataaaaagtactcttgccttcccttgtttccccaccaagaaaatccttgcacctgttcagtcccctaaatcagtggttctcaactggatgatttggctcctggaggacatttgacaacgtccagagacattttggattgtcacgactgggcaatgctacagacatctagtggatagaggccagggatactgttagacattctacaatgcacaagaaagaactgtccggtcccaaatgtcattagtgtgaaggtcgagaaaccctgctccaggtctagctactaattgccaagaaatacagaggacagagaatgtgttaaaggacatcaggggacacaatgaacacaagccagactgtgggaaactccaggacaagtgacctgggtttttttttttaacaagtaaattgcaaggggtaaagaacagaaatagaaggaaaccccataaattgaaaggcttatgagacatatcaactaacttgaacataaagattttatttggactttgatttaaataatcaaactataaaaaataacaagatgattggggaattttaaaaactgactcaatatctgattattttaaagaagagttgtttaatttttaggtgtgataatgatattatgattatgtttcagtccttatattttagagataaatactgaaatatttacaggtggaattatacaatgtctaagaaatacttcaaaataatggggagaataaagagaataaataaaacaatattagttatgagttcatcattgatgtaattgagtgatgcatacaaaggggttcactatacacttcatgcttcttttgtatatgttaaaaaaaaccttccatactaaaaaaggtttagacaataatatgtaaaaataataaaatagctaagtaacctttaaacaaaaataagttatacgtttctattcctaaagcaaaatcttttaagagcacaggcatatggtttagacctaggttaaaatcctggctcccctactcttacatcttgataatctttacaatctctgtaaaacagagctggtcctcatacccaccttgcagcattgacgtgaaaagtgggtaaggtggtggctggtgctcggtgactggcagttccctttcccactttccacaagagctttaaacaaagaaggaaaacaaaatgggatcactcctgcaacccatcccctatactagcattttctaaggactttgatcgaggccattcatttccttcttgtatatatctgactgtgaccagatcaaagcactaacaaaagaataagaagtttcttttctacatttcctctgatttctgaggtttttttttttacactgctccataaatgaaacttagctataaataaacaaggtagagggaaataggaaagaatgcctcactgcaaaatcccttacatgcatgtgattcattttaggtcacagtgtgccctgaagggttcatgacttgtatgattccagaaacagtaagccaaatttggttttctttccttagtgaatcattatttcaccaactatttgtacttaaatttttttaaataaaaaaaaacttgattaaaaattcctgcccagatataataacttacaaagctcatttcctctgcttcgttcccttttacagcagctacttacatattcgtatcctgccaggtttttgccagaaggttcattggcaaagttgtgagccggttgtattagtgactttagtcttggctgcaaacattctgtttcagctgacttttattttccccaaagtagcagttcctttagtcccactgcatttgcaataaagcactcattttcatctacttgtaaataagggataaagacacagacttttggctggtggtacaggcctctggtggtctcttaacttgtacaagataggactttctccttctgtaaataaagccctccatgaagagcaatcaccagacttggaactagaagacaaattaagccctatctctactatacaacctcaaacaagtcacgcttctctttgaagtttttgtttattcataagagattataatagtgcctgccctattgtcctcataaaggaacctaatagtaacaactagaatttatataatgctctgaaatttataaaatgctacaaaatataacatatggtttatcattattattaatcaaaaatatcttcttcatttgcctaaatgaagaacctactgtgtgctttacaaagcactgaaaggagaatctttgacccctaaacttgctattctgtggcatccagacacacgctaccatctctaaacttgccagagtttagtctaaattctttgcataatttccagagtgaaggtaaatccaaagtggaaacactgtaatgtctttcaaaaaataaagacatatgcacatgtatgtttattgtagcactatttataatagcaaagacttggaaccaacccaaatgcctatcaatgatagactggataaagaaaatgtagcatatatgcaccatggaatactacgcagccctaaaaaggaacaagttcatgtcttttacaaggacatggatgaagctggaagccatcattctcagcaaactaacacaggaatagaaaaccaaacgccacatgttctcactcataagtgggagttgaacgatgagaacacatggatacagagaggggaacgtcacacatgtatcccagaacttaaagtaaaattaaaaataaatagataaataagaatatttcagatgaaaattagaacagaactgtactaggaactctgctaggaaatggagagacaatggcaaatagcacagacatttctcccaaagaaaaataacatgcaagggagaaagcactggagaagggtcgtttttaaaaatgcaccatgtggtcatggtatggatggaagcataggtcttgcttttgcacatatacaagtatatcttccatgaacagtatagtttgaaatgtacagtgactagaaacaatttgcttgccataatcaatgtatgttagctcctaccctagtcacagcaccatattgggaagtttagcaaaatttacacaagatagttcttttatcagaaagcataaaataaaccatttgtatcaaaggaaggaatttagagacaatccagagaactaaaattaaatcaaaattataaaacaatagaggagatatcccgtgagaataggctaaaacttgaatcttccgttggagacataataactgaaaagtttatgatcaagatttctaaggtacacaaaaatctgctcaccaattaatggaatactgggataatttcttgaagtttgaaatataaatttaagagcaaacaaaaggaagtacagtcaggaaccgcatatggctctttcggtcaacgacagaccgcatggactacatgtactacagtggtcccctaagattataataccatatttttgctgtaccttttctatgtttacatatgtttagctacataaatacttaacattgtgttccaattgcctgtagtatttagcacgggaacatggtgttcaggtttgtagcctaggagcaacagtatatgcctagggtatatactgtttaccctaggtgtgcagtaggctataccatccaggtttgtttaacaacactctatcacgttcacacaacaacaaaattgcctaataatacatttctcagaatgtgtccccctcattaaatgacacatgactatatctttatacagcacatagtaaatttatgaaatgcaggactgcacgaaaaggcctgtcagaaatatatgttatatgtatatattaaaatatatatatattaaaaactcaaggaacttctggaaaaattcataaacgctagacttgtaagaacttttcagagaaactaggggccagacacagtggctcatgcctgtaatcccagcactttgggaggccgaggcgggtggatcacctgaggtcagaagttcaacaccagcctgaccaacatggtgaaatgccatctctactaaaaatacaaaaattagtcgggcgtggtggcgcatgcctgtaatcccagctactcgggaggctgaggcaggagaatcgcttgaacctgggaggtggaggttgcggtgagccgagagcatgccatcacactcagcctgggcaacaagagtgaaactccttctcaaaaataaaaaataaaaaacagaaagagagagaaactgtggtatgcctgagattaaagacaattatatggactataggactgacacagcagactaattcctatcttctcatatcctaacacttctatataagcctcgaaagaggaagattgttctttacttacctgttactagataatgaaccatgattgcactttcttattttggtgtggtaatatttatacattatacatagaatactatgatttatatgtcttattttgtggtgatcagttacaaagagatatagtatgctgctgttataggaaaagacattttcaaaatgtaacacttttccaaaggtaatctgaaaaatgttgagttcataaaagcaggaaaactagtgagaaatttgacctagaaacttactatagctgtgtaataacagttaaaatttaccaaacttgattctgtactcaatgtatttaattatccttcctttcagaatctatgttcatgttaaaagtttcttactataaaaaatacagaaacttgatgcactaaggcaggacactcttagaatgtcttgttaaaaatagactcttatcagaacatcacccctaatccacaaaagaatctgccaagagattgcaataacaagaggcatattgtaggcatttatgtccatcaacaaatctaacaaattgattaaaatgccaaagggacaagggtgaaaccaaatacagtgcaaggactaaaacagactcacggcagtcattctcatcagctccatcggggcagtctctgacgtggtcgcacctgtattcacttgggatacactgaccattggagcatgttatctgatgacttgagcatgtactttgtgctgcgaagagaaaaaattattacttaatttataattattgctagacacagactaatctattgtcattaacaaggatattggaaagcataaagttcatagggacacaaggtaaagtacctggctaccaccaagctgagcttacaaagcaaaaacagaagtataatgttatcaaaatgcccagagaatagtgtccacactcaagcatgctatgtacacaattacgttatcaacatgtgtaaagaatacaatatagattttaaaactatatggtaaaaagtttaatgaaataaaaattttgcaagtataggtattaaccaaggacccccaacccacccattgaaatccttgtataaacaagaaggaaatataccaaagctttaatagcagttattccagagtggtgtgaatatgaatatgagtgattttatttttttctatatagtttcctctattctataaactgcctacattgaccatgtatcaattttataaagagaaaaaaatttaagctagcttgatttcatcccatgttgattagtataggtgaaagcagggcatcagcagttcatgaaatttgcctccggataaaacagataaaatccagtgaactgatgcccgcaagcatgatgtgaaagctatcctgtaaatctgaggcaggaattaccataacatggtaacattatcttatcctgggattttaaattgtctacatacaaagagctttgggggaaaacgtgatcatctaaaaaatataatataatcccctaatggaagaaaaaagatttgctctcaatttttacaaaacttcttttttttataattccttttttattattattattttactttaagttctggggtacatgtgcacagcgtgcaggtttgttacatatgtatacatctgccatgttggtgtgctgcccccattaactagtcatttacgttaggtgtatctcctaatgttatccttcccctctcccctaccccacgacaggacccagtttgtgatgttccccatcctgtgtccaggtgctctcattgttcaattcccacctatgagtgagaacatgcggtgtttggttttctgtccttgcgatagtttgctcagaatgatcgtttccagcttcatccatgtccctacaaaggacaggaactcatccttttttacggctgcatagtattccatggtgtatatgtgccacattttcttaatccagtgtatcattgatggacttttgggttggtcccaagtctttgctattgtgaatagtgccacaaaaaacatatgtgtgcatgtgtctttatagcagcatgatttataatcctttgggtatatactcagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcttgactttttaatgatcaccattctaactggtgtgagatgatatctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctctaaactgctcttctcacttcatttcattcatttgatcttcaatcactgataccctttattccagttgatcgaaacggctattgacgcttgtgcatgcatcacgtagttctcatgccatggttttcagctccatcaggtcatttaaggtcttctctatgctggttattctagttagccattcatctaatcttttttcaagatttttagcttctttgcgatgggtttgaacatccccctttagcttggggaagtttgttattaccgatcgtctgaagccttcttctctcaactctcaaagtcactctccatccagctttgttctgttgctggtgaggagctgcgttcctttgaaggagaagaggtgctctgatttttagaattttcagcttttctgctctggtttctccccatctttgtgattttatctacctttggtctttgatgatggtgatgtacagatggggtcttggtgtagatgccctttctgtttgttagttttccttctaaccatcaggaccctcagctgcaggtctgttggagtttgctggaggtccactccagaccctgtttgcctgggtatcatcagtggagtctgcagaactgcaaatattgcagaacagcaaatgttacttcctgatcgttcctctggaagcttcgtctcagaggggcacctggccgtatccggtgtcagtcggcccctactgggaggtgtctcccagttaggctactcgggggtcagggacccacttgaggtagtctgtccattctcagatctcaaactctgtgctgggagatccactactctcttcaaagctcagttggaaatgcagaaatcacccgtcttctatgttgctcacgctgggagctgtagactggagctgttcctattcggccatcttggaacctccctcctctcccaaagcgctaggatttgaatgccacaatacatattgattcatgtttttgtccattagtggtccgtgggtatctataaatgaagtctattttagagtccatagatatcagcgttctgcaaaactgtcagggatccgaggctcccagcctacagagcttcttttacttatatgtagtatagatatttaggttcagcaaaacttggttttctgataaaattagatctgttaaggaatgtacccccaaaacttaacatgaaaaaccttttcaaacgacaagtaaacctggcacagtggctcgtgcctttaatcccagctatgggagattgaggcaagaagatcacttgaggccaagaattcaagactagcctgggcaacatagtgagatccttatatcttaaaagaaaaaaaaaataaatttagctgggcacagtggctcacttccaagtagctgtagtcgtagctatttggaaggctgaggtaggaggatcacttgagccaaaaaaaacttctctttttatgtagttagagtgagctataatcatgccactgcactccagcctgggcagcaaagcaagacccctgtctctaaaaaaaaaaaaatatgtaaaagataagtagacagtgacagttttcaaggtggtacttgaaaattcaaacatatagaaattatcatgtgataagatataataattataaaaccataattaacacccttctccatgcttaattgattatatcttccttgtcattttgttccttctttctgtttaattagcaaaatggtgtcttataattctggaacagcaaacaaaatttttcaagtcagcctacttctaacactaaataatttcatattttctctaagtaccttatacctgtgggtccaattttacttctattaataaaggcagaatagatagatttttccagaaggcacttaagtgtctgaattctgcccatggcagagacacaattttatctgaaaaaggttaaagagattaatacttcctcattaaatttccaaataatttatttaagtatatattgccaattttcacataaaattaaagaactttcttttattcccgagaaggcaagtcatgggttgtctcaaacaaaatatgaaaagaacctgggtcaggtatcagtgctcgttcaattaccttggctttcttctttacgtcaagcccaaataattctaaatgttgtgcttaggttttcaaagggcttacgaagaagcaattaaaagctcattcaaatgtagagagcaaacaaattaaaattatataattccatcaacctatctaatgctgagattcatctattcattaattacacaaacatctgttgagggcctataatgtaccacacagtatagcaatatggggatctgcaaatgaataaggcacaatccctaccctcaagaagctcatagtcttctaggggacactaaggagtaattagaaaacaattatgaaagtggattataggcacacaggaatgatagaaccatcaatccaggaacttaattcactctgggatgggagcatggatggggacagtttccttgaaaaagtgacacctccctgggtcttaaagaagcagcagtcaggtaggccaaaagcaaagaaggactgtctagaaccgagcattcagcattcagccagcttgcacggagacaaaaggctaggacacagcatggcacacccacaggaactaaaagcactgctgtgcccaagtggccacttcaaggcaagaatagcaaatgatagacataggaaaataagcactagtcacatcttggaagccactgtaaaccgtgttagggaattggaactttctcctggaattaatggagagctaccaaagaatcttagttagatcagcatcagtgtcagagagaatctaaggatccacagaactggaggcagggaggccaacccagagactactgctgacacccaaatgagagatgttggcagtgggagcagaaataaagagatgggtcagacatggtggctcacacctatcatcccagcacttggggggccaaggtgggtggatcacttcaggccaggagttggagaccagcctgggcaacatgggaaaaccccatctctacaaaaaaaaaaaaaaaaaaaaaaaatacaaaattagccaggtatggtgccatgcgcccgtagtcccagctactctggaggctgagaagtgggaggaccatttgagcccaggaggtcaaggctacagtgagccatgattgcaccactgcattccagcctgggcaacagagcaagaccctgtctcaaaaaaaaaaaaaatctgtccttgccaaaaaataaaaataaaagagagagaaatgaagagattaactttagaaatatttatgaggcaaattaggcaggagttggtgattcaatgtgggcagtgaaaaagaggaaggaatcaagaataacctccaagtttctagcgtgggtgcctaggggattgtgatagccttttcatgttaattgattatatctttcctgtcacttacagcaatctttcttcttcatctaataaaatactttcattatgaaatatgtttcacaaattcaacaagtaagagagcctccatctgcctatttccaatagtttaagactgattttgtattttctgccagtgcctcatagtgggttaaatgctatttctattaataaagataaaatatgtagactagcaaatatagaaggaaaatccagttcaggagggaagatgattattttcagttgggacaccttgagttcaaggcaacttgcagaggtccaaaggtagttgagtatacaagactcaagtgtgggcaaaaatctgggttgtaaacacagatttaagtctcatcaggccacagagggtcactaaagtcatgagaatggtgagactatcctgagagtgtccagaatgagaaaagctgctcagggcagggctctgagcaacaccaatactcaagggctgagtagaagaggaaaataaaatggaatgaccaaagcagctcaaaagagagccaggactgctgggagtcatggcagccaagggagtggtgtcaagaaggaggaatggtctccagagtcaagtgcaatctaaatgcccatccagtgtgagaaggaaggaaaagtgcccattggcaatcaggagttatctggtaactttagtgaatacagaggtggcatattttgtttgtggttaaaagatatctaatggagaatttttatatcattaaaaatgggagaattgcctcatgaaatgtatagtcatttaaaatgatatgcaatattgttttaaaatgactgctataaacttatctccagtctcttttcccaagcagttgcccttagtagttccaatcccctctgtaaagtattattattagcaaagggtcatccaccacacattgaatcgcaaaataaagctcagctttcttcccactctgtgagaggagtaagagaaaatagactcaaaactatatagcctaaagatgaacaacccatcatttatgcatttagtatctatctattaagaacctcctctctgcctgagagaatgtcaggccttcaggatgcaaattttgagacttgagcagcttttatgcaatcaagaaaggccaataggataaatatggcagagcaaaaaagtgagaaaaagctggataatatttctgagctgggaattaatcaaccctggaacaaccctatagttaggcttcttattatgtgagataataaatcccctttttgtttaacttttttgagttgtgttttctttccttgcagccaaaaacatccacaatgatacaagaatgattttaaattatacaaatatccttaatagagaaaggaatggaatgatacatgtgatagacaaattgctcataggtcgccatcttatatttacccaacattacttctcatctaaaattattttcaggccagtcatgggggggtcatgcctataatcccaacattttgggaggccaaggcaggaggatcactttagcccaggattccagaccagcctgggaaacgtaacaagatcgtgtctctacaaaaaatttaaaaattagctgggcatggtggtgcacacctatagtcccagctactcaggaggcttaagcaggaggattacctgagccccggtgtttgaggctgcagtgagctgtgatcgcaccactgcactccagcctgggtgagagagtgagaccctgactctaaaaataataataaaataaaaataaataaaataaaattattgttagacctattaaaacagtcttttccagtctgattccaaagaaattagaatttaaaggttttttccaggttactgaaccaaaccccctcaatgtccagggatgccgcagttgccaagatccgcttcatcgctactattttctttcttgttcaagctctccctatggtggctgtggcagcagtcactgaagtaaccaccaagaagccctccaacaaacctacctacttccactcagtcaaaaagaagagaatttaatattggggcagaaggagtggaaggtttgaatacaaagtatgccacagagccaaaggactcattcagctgtcaaccacacacatgaagacacccagctatacactccaataaatatttggttcctttcttgagcataacataatcaaaattaaagattgggaacctatctcacttccaaattgctggggtatattcataattcttcagtacatccgtactttcaatatcatccaacccctgaatgagattgctggcataggttcccttatgatttaaggccctgctccacatttataaagaatcatcccattgtgtgtaacttctttgcgacaggttgggttttaggtgtccacaaagccaaagcaagattcctctccaaacacttacagcaatcttgacgttcatctgagccatcatcacagtcttgatcttggtcacacacccaggagttggggatgcattgtccctcactctggcacttgaaatagccctgctggcaggtcacaacagctaaaacaaaccaaaagaggactcattatggcaatcatcctccccattatactagcaagcaatgcttgttccagaagagtgtatcatgtaaactcctgctcaatttatttgaaggcaaatagtaaacaacccttatactagagtctgtggacgccagtcagagttcactgtcaaataagctcagcaacagcatcacaacaaactcatgaaccaaagcaacttaaaaacacagagaataaaacaaacagcacacatacacacaaaaaaattatgataaaggtattagattaaaagcttcattcaagtaaacattaactgtgagttactgttaaactatttgtttcataataactaatagtaaagtatcatgatgaactggaaaattcatgagatttgggaaagaaaacccaaaatcaaataattattatttccatgatttacttcctttaagatctttggcaggttctctgaacctcaatgtatgcatcataaaatggggactatactcatctcactgtttgttgtgaaaaataagttaaataatgtatgtgaaagcgccatgtaatgttacttgctatcactatcgtcattgatattgttgttattgttattatttttacaggtcaataaaatataatacaggtaacaatctctgaagagttgttggcatagctgttcacttattcctttaccccagatacactgcccttgcctttttgcttttattgtttaatcaaaatgaactcagtaagcccagaggaggcaaatagttagcacatgattgtgtctctacaaatatagtttagtcccttgttcaaagtgcagtccacaaactagcagcatcaacatcatcaggaagtttatagaaacgcagaagctgaggtcccacctcaaaatatggaatctaaatttgcactttaatgagctcctgggtgatccatttgtgcatgagtatttgaggagcactgtacagaaccccatccttacccttcctcccattttcaaatgcgttgtcatctaaatgacacaccaaagtttgactgctatggtatgccataacatggccaacaattcaaaacaaaaatttttcacctgctttcctgatttttgaaagataaccctcattagttcacctgctgggatgaaggaaattgcagatgtatgattgatcacctatgggaagttgggaagagcaatgggatctgtgcatagacttaccaactgtaagaactttaataaatgacttaacttctccgagtctcaatttactaatctgaaaccgacctcagaagattagtgagaaaactaaatgacaaaatgaatgtgaaagtcattttataattaattagatttgaagtttactacattatcgtatttttcaaattttttaaaactagaatttttaaaaaacataaatcacactaaccaattctgtgatttctttatggtaattgacacaagttattctacatcctttacataaaaatggactcctctttgacttacaaatcacagtagttcagataacattattttttgtttgttcttgtgggtacacaaaatttacagagtgaatattagaaataatcacctacagactccagaaaactgcacccaaatatgtttccatatcaaagttgtggtcaagggataagggtgagatagaaactgatgctctatcatcaatgtgaattgaacccctacctcagaagggagtgaaattattgttaatgccatcagttctctattcaaccacacagatctcaaaagacttgggcccagacctggctctgtcactaaaaggcatagctcttctctttgttacagctgaaatcaccaggaagcacttaggttactcaaaatagaacttagcctggcccctcctcacttaccgcagccaatttcatccgcgtcatctgaacagtctttggtcccatcacacctccagtctgcagggatgcaatgcccacttccacagcgaaaatgcgcactgtcacattctgcaataatagacagaaattttaaaaacttatgccatgcagatatttaaccgaagaaatataaatttttgataaaatgaaaaattattcaactaattagataatcaaagaaatgcaaattagaaaattaggtaaacattctcccaatgataatataaaaatatttatttgaacatccgtgggaagaaagtgattttcatacacagttgattagtgtgtatcttgatggaactcattgggaaagcagtttgacaacacgtatcttgctttttaaaaatacttgatctttaatttagtacttttacttcaaggatttttttcctaaggaactaatcaaagaagtagacaaagatttatgtataaagattttcatcgcaacattatttataacaaaggaagttgcaaacctcctaaatgtccaacaataaaaggattaaatttgtttacatctttatattgacatattagtaacttaaaaaatggttatggagaaattctaagtacttagagaaatacttataatttaatgtaacaaaaacaaggacgtaaatttttactgataacagagttacatatgcaaaaaaaaaaaaagcgtaaaaaagaccagaatgttaacagtggttatctctgattgataacatcgtgagtaacttttcatttgcttgactatactttcttgagttcctcaccttattttttaagtgattttttattactaaatcatatatagcaagttatggcctttcattcttagattcagactaatattttgtcttaatttttaaaaattaaattataacttgccagatctataagctcatctctgcaaacaattttttttaaaccaaagagccaaaaacaaaacaaaacaaaatctctgcagccaacaagagtatacaaacttgacaccaaaagttgacaccccaagtggcagtgatagtccctagtgatactggaaggacaatataacttaaacaagctcacttcactgaactaatatatcctgtgattttcctaggtctccccaagggacaaagttccccaaatacctggccagtgaccttcccaagcattatgtgccacatagaaaaatttttcaaagaaagcagccactaccagccccacttagagaagactcaaaattattttattctttcacaaacccaagggataaaggagaaatttttgcagttggaagaataattatatcttccccatgtatttaagcaatcatgctaaattacccatttcaatttttggctaattaaccaaaattaggtaaatatacagatcaagtacctactcctaaaataaataagcaatgtgctatcctgatttgtgtaaatgcaggcatatcaacagcatgacataaacatagttaagtgatctatttctagggtatataggctactttgttcatggaatgttcaaatctgattgtctggtagtgacatcctgatttataatgtatgctgcaaatggtcagaaacttcgcttggctaaatggtggtaccgagtggtacaggagtacgtacacccaaataccttctatagactaatgcatgatggtggttggtggtgcaggtctggggttggtggtgcaggtctcttatcaactacctttaaaacacaacaacctcccttgcaaaaatgcccctaaggaatgtacaaattcactctggaatcccagaacttctcattggattttgttctacaaagcaatatttccatgggagattaggggctttggaggtttagctattaacacaacatatattaaatcacttttatcaattaggtctattgttagtaatccaacataatacatttgtaagttcagtacatttgtctcccttagtatctgaggttgtaaaggtagtatcttctggttgaaaaattataacaatcataaagaacagtcctcttacagacagtttcatattgctatggagaaaagaaaaatataaatttagagactgagtatttaggaggaaattatcagaacaatatatattgcctgttttgaaaatatatataattaatgctatttcttaagcaacttttattacaagtcccatttttgaggagtggggtggggggatttgtttgtttttgccaaactaaaataccaagttaaacacatcatgaaaagaacacaaaatagagactcaaaagtcattttataaaacacttcaaagtcaattatttaaaatcacacatatgaaaaatgaaactgatggggaaatgttgcaattaactaatttttataggtagtgattttcacacttgatctcctcactccattatctaatatatcaaatccaatttactcaatttatcaacagatctataattcatttgtcaaattcaccttttcagtagtaacttcgatgcctgtttataactcccaaacgactattgtttggaaatatctctccagaaaaaacaaactgatactttatcattgctgggtgacctctcagccatcagccaaaatgcttcactggcctcagaagctcattctctcataaagggaatatgtgttgtttaaaaataaaccaaaaataaaccactagtgaaaaggtctagattaggtctaataacaattgcaggtgccccttacttcaattagtctatatgcaatttattttgagtgttttgttttaaataagtagcctttactcacaagccctccaaaagttttatctagatattatctacattttgttatttatttgaagatttaaaaaaaaaaaaagctaaggggatgatttcatacattggagccacccacagggagaaaaaaaaaatctacatagaaccagctttaaaactttgttcagaaaatagtctcaaaactgccacattcaaccaatccagttttagccaagaagtaatcttgcaaataatcatttatgtaactttaaaacattctccaggagcctctctggtttgggggctgcctgattaaaaaaaaaaaaaaatccctctagtaaaaaccaaggaggaaaggaggaaaatacaatccacattgaaataaaaaccttttgttaagaaccaggcaatcatcacaaaggaaccatcggaaccaaatgaacaccctatctctccagcactagcccctgtctgtcccatcaatcagaatagatggtgcaaagatgaaaagaagtactcatatagcacttaaatggcacacaccattctaagtgctctgccaacattagctcatttaatcctcataataaccctatgaaatagatactgttattatgaatattttacaaataaataaattgaagcacagagcaattcggtaacttgcccaagatccaacagcaaatatgtgcaaagcaaggatttgaatctgacagctctgattccagcattcgtgctacttgaccactactctatgttccctttcaccaaaaaaaaaagtttattccactaaactcaagaatgaatgtaaaaatctgatttttttcccccaaagctgctctcaattaacattaattgagttcattattgggctggcatagaatccatagtgcttatatacttcagttggagaaaaagagtagtttacttggtgactaacatagcattaaaaaattattgggcttaggaaaaattgcagcaattgaaagcaatgcaaaaaaaatttaagcgttttgaaatcggtagtaaaattttattagacataggaataaacttgttttccaacctcataaagagcccaaagctaggggaaaaaaaaaaaaaaagagtaatcctttcttcataagtagccatatcccaagcttcctgggtaagtgttggactaagaatgtgttaagataagatattagagtaacagatagcgcccagagaagaggagtcatttgcctgtttgttttccacagcaaggaacaacactggattgagagcattcctctgtgtcatttacagcctctggcacagcaccgggtgcttatggaatagctaatgcatgttcgtcaggaagtgtagaattctctttgtaaaactcagcctgctgagaccattatatatcagagatatagaaagctatcagagcaaacaatgagactttaaatagaaatttaccatcttaaatccatagaaagaaaaatggaatctggaataatctgaaaaaaggggaatatctagaagtttttttcaaaaaaaaaaaaaaagaaagaaaaaaacattgagtcatattaatagcagtttcattcttttacccgttccttgtaagtttctttctccttccataaattctattcttataagacaaagacaagtggtagtcaatggaacattgtccaaagttaacagagtaaggtaatttctgtggcaaatcctatttccccgctagatcctcttaacacatgctggtccttccaaacacttggtctacctgaggaggtacagtcctctttttaaaaatttgtatgagtaaatcacattttaatagttccaccttcactgaactcaaagaaacaaacaaatttaagaggcaattccttaacttatccataatttttgcttcactttttctatacttaattttgattcctttggtatggatagacatccttctgatattcataagttggctgacagttcactacaattcccataccttgcccacataaacaaggccagtccccttttgaagatttagagtcacctgcttatttccaaaactttacactatagtgatgatagccaagggtaacaaattgtatggagcactctaccctgtctagtgtcaaattgatagaatagtcaaggattcagttaatgaaactgaaacaagacaggaacagcaaaccaacctgctagtctctttctgtgcaacattttaactgtctggttttccttacagatcatcaaataggtggcaggaattcttttgggttttttttttaatccagtttacaaaccactgaatagactgctttgtcccaattattgattcagagccctgatgttttcttagagcaaaacaatactataaggacatttcaagaagtcaaagatttggggacaaaacccacaatgcaaattgatgcattatcatgtagacacatcatttaagtgcaaaaataaatgaataaataaataaggaccaaaagaatatgatgccagattcactaaagccacaaataaattcataactactatatgcaattgtcctaggatcagtggaagaaaaaagaaaaataagatatggtccttttttgctctgcctctccctctccctctccctctccctctccctctccctccccctctcccctctcccctctcccctctcccctctcccctctccctctcggtctccctctccctctctttccacggtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcactgtgttggccgggctggtctccagctcctaaccgcgagtgatccgccagccttggcctcccgaggtgccgggattgcagacggagtctggttcactcagtgctcaatggtgcccaggctggagtacagtggcgtgatctcagctcgctacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcgtctctgcccggccgcccatcgtctgagatgtggggagcgcctctgccccgccgccccgtctgggatgtgaggagtgcctctgcccggcggcgaccccgtctgggaggtgaggagcgtctctgcccagccgccccgtctgagaagtgaggagaccctccacccagcatccgccccatctgagaagtgaggagcccctccgcccggcagccaccccgtctgggaagtgaggagcgtctccgcccggcagccgcccagtccgggagggaggtgggggggtcagccccccgcccggccagccgccccatccgggagggaggtgggggggtcagccccccgcccggccagccgccccgtccaggagggaggtgggggggtcagccccccgcctggccagccgccccatccgggagggaggtgggggggtcagccccacgtccgggagggaggtgggggggtcagccccccgcccggccagccgccccgtctgggagggaggtggggtcagccccccgcccggccagccgccccatccgggaggtgaggggcgcctctgcccagccgcccctactgggaagtgaggagcccctctgccgggccagccaccccgtccgggagggaggtggggggatcagcaccccgcccggccagccgccccgtctgggagggaggtgggggggtcagccccccgcccggccagccgccccgtccgggagggaggtggggtcagccccccgcccggccagccgccccatccgggaggtgaggggcgcctctgcccagctgcccctactgggaagtgaggagcccctctgccgggccagccaccccgtccgggagggaggtggggggctcagccccctcccggccagccgacccatccgggagggaggtggggggatcagcaccccgcccggccagccgccccgtccgggagggaggtgggggggtcagccccccgcccggccagccgccccgtctgggaggtgaggggcgcctctgcccggccgcccctactgggaagtgaggagcccctctgcccagccagccgccccgtccgggaagggaggtgggggggtcagccccccgcccggccagccgccccgtccaggagggaggtgggggcgtcagccccccgcccggccagccgccccgtccgggagggaggtgggggggttagccccacgtccgggagggaggtgggggggggtcagccccctgcccggccagccgccccgtccgggagggaggtggggtcagccccccgcccagccagccgccctgtccaggaggtgaggggcgcctctgcccagccgcccctactgggaagtgaggagcccctctgccgggccagccgccccgtccgggagggaggtgggggggtcagcgccccgcccggccagccgccccgtccgggagggaggtgggggggtcagcgccccgcccggccagccgccccgtccgggagggaggtgggggggtcagccccccgcccggccagacgccccgtccgggaggtgaggggcgcctctgcccggccacccctactaggaagtgaggagcccctctgcccagccaccacctcgtctgggaggtgtacccaacagctcattgagaacgggccgggataaaaaaaaaaaaaaaaaaaaaaagaaaaaaaaagaaataaataaataaataaataaaaagatatggtccttttttgacagagcctataagtttattgggggcaaaagtgatttatatgttataaattaaatatccatgcaataacaacagctgatattgtttactgagtacctactatgtgttatacaatatataaagctttatacatatccactggatcctctcagaactgtatgatgtgagatttatacttatttaatagaaggggaacctgagcctcagtgacattaaccaactcccccaagggccacaaaggtagaaaatgtcgaagtctgatttagccccaggacctgtgtgactccagagcctgtacttatttcatcatttcatgtcctgcaaagcaaatgacagcatttgttcacccagaacttgccagcaatattttaagtgcttcccatgcattaccttacatatcctcacaacagctttgtgagatggtatcaatggccccatttcatagatgaggacgacaaggcttgaacaaatctcacagctagtaggtagtggagcacagatttacactgaggcagtctgattccaaagctatgcctctgacaacagacaatttggttccaaataagcaatggagataataaaaactaactgactttggcgaaaaaaataacactacaggccggtgtcatcagagaagtcttcacaaagaattataagactacactgggtctttgtgaatgagcaggatttgggaaggtgaagagggagaccaggctttgtgtgtagggtcaaaacaacttgacaggccaggcgtgatcactcacgcctgtaatcccagcactttgggaggccatgccaggcagatcacttgaggccaggagttcaagaccagcctggccaacatggtgaaacctgtctctaagaaaaaaaagaacaaaaacttgacagaagcttagcatgggtgagggtctaataagtatgacccaagcagtgatgacctcttggagagtggtaggcaacaaggctgagaagatggagaaaaagagctttcagtgccaagccaaagagtgcctgtcaaatgagtatgagggtgattactcagacaataactgcattaaaagtgaagatcactctgagtaggtaaagcctgaactagcatacagactttgaccatgaaaagagcttggagctccacttcaatccccagaacctcaccccaaccctgagcccagtgagcaggctggtaggtgcaggcaagaggctgctagcagagaagggtctcaccttgcagcccctccagctgccccagaagcatccaaagcaggtccgcttgcatggcaaactacgaacaggttccatgagggaggggtccccagtccctgggctacaaactggtactggtccgtggcctgctaggaaccaggctacacagcagcaggtgagaggcgggtgagtgagcattagtgcctgagctccgcctcctgtcagatgagtggctgcattagattcccataggagcacaaaccctgttgtaaactgcacatgagagggatctaggttgtgcattccttatgagaatctaatgcctgataatctgaggtgaaacagtgtcatcccgaaaccatccctcccccaccaccaccctgctgtccatggaaaaattgtcttccacgaaaccagtccctggtgccaaaaagcttggggaccgctgccttagggcattgccaacaacatcctagtgaccagcccccaccatcctctccaagctggatgtttctgagtatccaggccacagaatccagtcagctctcaagatagttgatctcaaagattacttaaatatttgcttagtaattaaaataaagtgcctttccaataaccaaatggcagcagaatgagatgtactacttgagcagcctctcaattctgagcaatgagagatttaaactgagccatttataactgagctacccttctccatttccatttaaacactagtcacctgtctttctcccccaaggctcttacatcccacttgttttttcattatgcacctctcacctctacaatcaggcagtccatcagcactacagaacattataagcaaagccacacttctcagaggttcttcagaggacgctatcgccatttggggtgggacaattactcatcttgcagaactgtcctggtcaaagcagtatgtacatcatccctgacccccacctgtggaacaccagtagtgctcccccacatcacggtgacaaaaacactcccaggcacatctatgccgcttgagagtggcagtaccacccccagtggagaacaactcagaacctctaagcagcttggacagtcagagctcaaaattatcttagcccacatgaaagagatcatctaaaaaaaaaaaacataatacattcttcccttctaaagataataaaatttcttaaacagcaatcccactccttcccacccatcaataagagcacctaggattgggcaatctcacgctgcagctgctagtaccagcaacttgaaatgaactcccctgggagagtgataaagaatctaatttccaggaaggcctgtttcaccctggaatgctccattccatcacacgtccacaggtctaccccttcaaggggaggggaccacactagaaaaacacaagcatctgaaatcctcaagtagttcatcattaatgtaaaggattgtggctatgaaaaacagtcataagcacctctgcgttgtggtgcaaacttttcccgtccgtattcattatcagagcaaaaaaataatttctccaaatgtcctctccccatcccaactgcatacattcacaaaaaattaaaaatataaattgacaatcacttaagcgctcaaacattcaaaagaatgtccaagtttttaccaagaacgctgagcaatgaaaacttcctgttagccagcatcaaagcactgaaagtgtatttgtaccagtcttttctgtgctccccctgaatagctcatgcagtgcctcctctatcagctaagtcactgaggttcctggagaggaaccttccctacacgtggaaggaaactaagctcaagactttcttctcctctggccccaatccccactagagactaactggttatttacatctttcatggtaaaagagctacacttacaggatgttgaaaagaacactatccaaacagaagaaaatttaagatggcctgcctgcccaggtaaataaggacccaatgaatcaaactacttacaagaataacatgcccttcagcacctcatgatttgacacaccctgtgcaaaaactacaaatcattcccatttcagagcacatttccagtcccagtcacccagagaattcctatacggctttttgattagcaatataaattactggaaaatggttgagtggaatcaaacactaaaaaagaaaatggacattcatgagaaataaatgacaagagagactttagaaaggcagctttcttgcttaaggcttttgaatggtgtttcagactagcattgatagacagcatcaaattagggttttcctgattaattaggtccaagtgttgaaccataaatcaaactgacatggatatgttaaagctataaacatcactttcattttggtcatcttaataatcagatgagatcaccaggttatcaagtgaacaatagttggatactgcaaattatgacaatagcaacaagaagagaagaaattgactctcaattggtagatttggtaattccccatagtcataggctaaattatttataactactaaatggaccttcttgactgaatcttataaacaccttgctgtattccttctccctaactccatattatttagttcttgactatcgcaatagtaacaacaagctctaaagaaacgagaagagagagaagaggcaaaaatagggagaaaaagaaaaagggagacagagaaaaagagggcagaaaggagagatgtcaaggttagcaatcagtgtccagacactaaatttcatgagacctagcatcttgcatcctagccttggtttaaatgacacctggcatcttgcaccttaacctcaatttggtacaaaatggcaactcacccttatttagctatggcccaaattcagattgaagcagtatgtaattgctaagtgggtttataagtcacaagttacatgctaggaactaaataacctcccattctaaatgtgtaaattttcagaaagtagagatcaggtatatacatatatatatacacacacatacgtacatgcacatacacatatatatacataatttactctaacgaaaccaatgcttcaacatcaataagcaactctgatgacaactcttatcagaaatgtttatgcttggtgatggtgaggctcattgcattgttattcacacaaacactaaactttattcacagttcattcgttagatgaataactgagttgcacacacaggcatgcctcgaccttgaccatttagtgatgggcatgtatggcttctgccaacagagtaagaattttcttaaactattaagaaatattgtgcagcaagagtgccaaaagatttccaacaataagtttaaaagccttttcttgggcagtaagtactgataattaatcatctagtaaactgaagtcaacatttttaataaaaatgtaatatgtcattctcttttttaaaaactggttttgctgatgttttacacaatatttttgtatttttcccctttagtgacaagttatgccttggaaatgattttataagcagaaagttcaaaattctcctgccacgacctggatatgtgaaatataaggaacagaacagatgagactaagcgacctctgtattcccagggcctgttacaggacctcctagtacccagcctaccctcaataaacgaactatatatgatgtgttagaatatatgtgtgaaactaagatgatgtccaaaagatgacaaagagatctacaaggaaggaaggagggaaggaagaaaaggaaggaaggaaggaacgaaggaaggaaggaagggagggagggagggagggagggggctacaagagtacttcttatcctacaatcaaaaattgtaatttgttttataagcaatttgctaatatagcataatcatgattttaatttccctatagagaaacaaatgtaatgccaaatcattgccttgtaaatctgtaaagaaggacctattatatttgcaaatactctcatggtagaatgaccttaaatttcctgtgtctcccctactggattgcttttaacagactgagcaaaaagaacttcagaacatgcctcaccagcaggttatctttgcaccaggagtcctttggccctggtttgttatgcctgggctcaaatagcatgaggaggtctccaaaccactttcaggctctgtcaatgttatcacttcacgttataatgtgattgtgatgacttgaaacaattcaatagcttgttgacacagaatcaacaatattacattgtcaccaactgatacccacgtgtgataaagtggtgttcaggtttctgcacagacatgatgaatttataatgtccccatattaatagcaacatgaataaaattacaagtttatctgcagtgattgccagaaatggaaggaaaaaaagcagggtatatttcctaagattttgcctaatctgtgttttaaatatcattagtaattacagtaaaaacctttgtcactattataaatataaaattttagaattttaatgctaaaaagaagtacggcttcagtaataaactataccagaaaatatatacaataaaatctctactaactgacacacaaataattaaagccatttgcttactggagttttgtttgtattatacttcttacaaaggcaattaaagaaaataaaatgatattagagtgttggtcaagaatagagttttcagtggccatctcaattctgggtgttgggtacctatagttacagtcttggatgagtatgagtgagctaatatgcagaacatggatccataggcattataataattaagtaaaatttaaattaaattcagtaagaatggctaaaataagaataccaatggaaaaagcaatcgccagaaagccaagagatgcatggctttcaactctggcaaagcactgactgtccctgtgtcattccaaactctaagttccatgagggcaggaactgtttgtgtctcatttaccactgaaccttcactcaataaatatttgttactgaactggtttagcttgatgaacctgaatttaaactgatacagtatgcagttttcttacctacaaaatttctgacctgcaaaatcaggttacggtgaggattaaagaggtccctgtaaacctctggcacaatgcctgaagcacagccgtccctccatgaagggtggttccttccagggcattcccactactcatctaattctaacattctaagagttgttcccctactatctgactgagagaaaactttcaaaatctaagccaccttgcttggtaggatgctcaacactgaaagcacagatggtggtggttgcctccactggcccagtcttcggtcaagggcaagagtgaaaatcaagatttattctgagaaacacaggtcaaactagagtcaaaagcaagcttgctcccaacttgctattttcttgtttatgcatttttatgtttattttcttgtttatatatttttgtattttcctacgatgagcatttttattattttgtccattgtaaatcattcatatttcaggtgatcctctggagttttacatgaaatactgtaggtgtataattccatcaccaaaaagaaattgatgataaacatacaggctttcccagaattgaccttaagtcattatactgtacattaaacttggacatcgttatctttctatcatcataaaaggatttctgttgacctcaactcatgccttggcataagccatagaattaaggacataaagaaattgaggattaatcaactgaaaccaagctaaaaagttttccattcaaaaagtttggccagcacagtagcccatgcctgtaaccccagcactttgggaggccatagcaggaggatctcttaagctcaggagtctgtaatcagcatagacagcagagagaaattctgtctcaatagaagaaaaaaaaaggaagttcagcgattctccaggacccacgtttaaaagaatttcaaatttttcctaaaagcatgaaaggccaggtgtggtggattactcccgtaatcccagcactttgggaggccaaggtgggtggatcacttgaagtcaggagttcaagaccagcctggccagcatggcaaaaccccatccctactaaaaatacaaaaaattagccaggcatggtggcatgcacctgtagtcccagctacttgggaggctgagctgggagaatctcctgaacccaggaggcagaagttgcagtgagccaagatagtgccattgcactccagcctgggtgactaagtgagacttcatctcaaaaaaaaaaaaaaaacaagcattaaaagtattcactatcctaattctctaaactttctcttatataacagaagaatgcaataaatgcaaaaatattatttgactaaaataacatacaataatgcctttctaattcattcaaagaaaaactttattatcttaagttgttaccctatttctgtttgaatgagaatagatttccataaacctagacatccagcccctgcaaacgaaggaatgaggccaggcgcagtggctcatgcctgtaatcccagcactttgggaggctgaggcagttggatcactggaggtcaggagttcaacaccagcctgggcaacatggtgaaaccccatctgtactgaaaatacaaaaaaattagccaggcgcggtggcatgcacctgtaatcccagctactcaggaggctgaggcaggagaatcacttgaaaccaggaggcagaggctgcagtgagctgagattggactactacaccccagcctgggtgacagagcaagactccatcacacacacacacacacacacacacacacgcacagaggaatgaaataccccattgccatgaccccactcctattcttttccagtaatgaaacagagagaccttaccaccctccaaagtattctccactgcacagagcaaacactccaaactaaatgcaacgcaacaaacaggtactgaagctctggtagaccatttatctttgtattcttaaggcagaataacacttgtcaggaaacaagccctcttgtccacaaccgtttggctatcctcaagcaagccaataaaactatcccatctccttccagaaaccaagaaactaaagtcagccagttcttccctgggaagagttatgttcactctgtttactataagcactcaacacttcacaaagtttggtgggtaaggttacaaagagggaaaagcaacttaaacttaaaaggctgttctgatagtccaggaatgagacgattagagccttatctagttaaatggtcccacctccgcctgacttcccccaccgctgtctaaaaatcctctccttctctctccctcagatccccatgacatggccagagtttccatggctcacgaccctgaccccaaaaatctgctcccaggtgaacttattcacgggaaggtttgagagattcttaaagccttctacgggtgtttgcactttcagcagaaaacagaagccctccaaggaatgaattttctaattgtggcattttaggcattcctaatgcctacataccttcctcactggcttgatggagcagattgtaggggaacagagtatcttatcagggctcctaacatcgtaccacataggttgtggtaccatgtataaggccatctttgctaatgccagaaacctcatcagcagtgagatagcatttttccataaaagcacaggccagcccaaatacagtcaaagggcttttcaggagaatttggtgacatctctggatcagtgcaatgtattttagattaatctggactgaagaaaaaggccctaaggaaatattgcaaaaacaatgactccaaaggcctcaagagaatccattaacacgtgaacatgattaatgaaacactcatgtgggttctgtttaaactgaaagcccttattctactatttgtaactcaaagaactccttccactggaaacaaaagattcatccattccacccaaagtggaatatatgtgtatgcatgcatgtacatctacatatatgcacacaagacagcccaatattaccaggcttactgatcaagaaacagacttgaggccaggtaaggtagctcacgcctataatcccaacactttgggaggctgaggcaggaggatcgcttgagcccaggagtttgagaccaccctgggcaacatagtgagagccagtatctacaaaaacaaaacaaattaaccaggtgtgatggtgcacacctgtagtcctagctattcaggaggctgaggtgggaggatcgcttgcgcccgggagtttgaagctacagtgagctatgatcatgccactgcactgcactccagcctgactgacagagcaaacccagagcaaaagaaagagaaaaagaaatggggggaagtagggaaggaggaagagagggagtaggggaggagaggaaagaaagaaagagagaaagaaaagaaagaaaagaaaggaagaaggaaggaaggagggaagggaagggaagggagaaagaaaaacaaagaaagaaagagaaagaaagaaagaaaaaaggaaggaagaaagaaagaaagatagaatgtaagagagacagagaaagaaagaaggaaagaaagaaggaaagaaagaaagaaagaaagaaagaaagaaagaaagaaagaaagaaagaaaagaaaagaaaagaaaaaaggaggaagacggagggaggaaaggaaggaaggaaggaaggaaaaagacaagacaagacaatatgcattccagaaggcatgctttatagagtgctcatttggccatgtgtttgtttaccatcactggattaactcaagaagtttcaataaatttgtccacctattgattcaactactgttacatatgaaatcattatttctccaagtataacagtctgtattttccttcttccattctgcccagcatgtctaaaagtcaacagcttttccacagaaggttaagagacaaagtctgaatagccagatgctgcatactactgggaaactactataatattacagaagggcaaggaaggggaagagcacgcgaagactgcttagaagccaagtaactgtccagggtgaagtccttctagtcatatactagggattcaaaccactgctccacctcttactaactatctgacagccattttaatttctgtgcctcagtttcctcatctaaaaacggagataataagagctcttactcataacattaatatgagggtagagtgaggattatgggtctggcatatcagtaagtgtttaataaaaattgattactgatactatttttaggccagtgttttctgatcctttaaactccaaatattgtctccctctcaattctacagggttttttttttgcttcttatatatttgcttatatgagagtttatgtatatatatagctcttctatattcatcatctgcaacccagtttgaaaatctattaaaataacctaattatgtagctaattcccccaaaagctaatttaatacagaaatttgagtattttattattacttttattttacattattacttctcttcccaactaaatctttctgatgtctaagattcacaaaacaacaacatatccatattcaaagtaaaactgaactagaaaaataaaacttaattcacaaagtcaagtttataggcacacatctattccacatgcgttcaaaaatatatcactacttagtgaaataaattaactctttgctaaattatttctctggttgatactagctgtgtttttaagacattttcaacaattatatttcaagggtgtttaagaaatttagtaataattaaaaaatacatgcttaactaaataacactaaccagttgcctaaacatagctatcttaatccaaagaagttgatagtgacaatatttattgaatcactgagttgtacaatatagaattactaacccctgttattagtatctacaattttaaaattctcctcacttcactctgataaatttggaaattgtttctgacttgatgatattttgaaaaacgccaagcatgggggaaacatagagaccacatctcacaaaaggaaaagtccaaagcttttcaaaatgcagactgctaagggtgttatcaccatagcaaccctcagtaaagagaattccaatatgaagtaaccagagaataagcaatattttaacctcaaaagcacaaacttatggatacatctatatggtatgcatctgtactatataaggtcaaaggttaaaagtgaccctaaagtcaaattccagcattcttttggtgcatacgatatatctacaatttctttcccatctcttagagtcatttagagtaagttttatccttcttcatataatagttcctcaaatatttggagagctaaccattgttcccctattctcttgtccaaaagaaacatctccagtttttccatcattcccccataatattgtttccagttttctcatcattcttgtttctctctttcaaataaggttcaaattttctatgcctctcccaaaatgtggtattcaaagctgaagagaagatgtgcagtgtcacccgaccagctttggccaggagcagtcatggcatactttaacattcatttgcctctctctcctcagtaatagaacccagtgttactcaggtgaactatgtgctgagctaaaaagctacattttccaaacttcagccaaatgtgatcataggactaagtcttaatcgatgagatcaaatgcaagcagtagtgttgtgtgggacttctggaaagtctcctttaaacagagaaggcatgtcctcctttctccttctgcaatcccactacctggcatagagaaaggatggctatggctacagcagccattttggacaatgaggtgacttcaggaatgggagtcaccagcagaggactgtggagcctgtgtctctaatggtatcatggaaccaccagaccagccttccactgctggttatgtaagagagaattaaatgtttgtcttgttcaagccaaacaaaatcctctctgcgacaggagcccagagtagagcatgcctattacctccccaccatgatggagttgctttactataacacatgctgttcttttgactttctattaaacaaaaatttcttgagtgcatgcttatgcctgacactgtgccagacacaagagaccagaggagctaggcatactcttagcatcagtggtcctgttctatgcctctcccaaaaggtggtactcttctagaggaagagataaaatacatacacaaatgattgtatctcatggcatgaggagacatgctgtaagagaggttcagataacattcagtggatatcaagaaaggtcctgtagagaaaggtgcatttaagctacagatagatggatctgaggggaggggacgcctcacagaggaaacaaactagaactggcacagaaacagggaagtgcaaggcatgtccaagaaaaagtcacattcttcatcaatgtcactggcacgtcttcaaattacaaagatcatacgtgaggcagattctcttttatgtgaagtaaaaaaaaattaaaattaaaattaaaataaatttgcaagatctttgacaccctctaaagacactaagtgcctccagagtcaattcaattccccaggcatttatggagcaccaactgtttttccatcaaataagagtttcttccaatctacaaaggcatcctaattttaaaaaaatttcatcaaatattttccatatttttaaaaatgcttggaggcgataacttgtcaatattctactaaactggcagaaatgtttccaggaggtatattctgatatttaacaaactgtaaagcacaaagcaagtgtggttctccttttcctcttattattaatttaaagttacaagaaagtaaagcatgtggaaaaacagagtattagagttaagtatgtgaggcccagagccaaatatcctactctgcctcagttcactcattagtaaaaagggaatagtaatggtatctacctccctggagtgtcacaagaacaaatgctatagctatggtgactatatatcaggcatataataagtttcagtgtatgaccgctcttattaccaatagcatccctttctgcctctctattcacttcctatcaaccaagatgggccctcaacaaaagaactattggcatttaagcccagacaattctttgtagtatggaactatcctgtgtattgcaacggtttagcattcctgtcctctgccctctaaatgctggcagggatactcaggcattgtgacaatcaaaaaatgctactatatgtttccaaaggttccctgagggagatgaaccaactaggaatcagtgaactaaaacaaagaaaatgtcacacgctatgcccagacagacagcaagctggaaatttttcaggcaggaaaattaaaaaaaaaaaaaaagttgaatatttatgaatgtaattaacatacacatacattgaaaagacatgtctaatattcccataaataaaacatgccaacttataaaacaaataacaagaattatcaaaaacggcaacaaataaaagctttctctttgttccatggtgactctctccttttctcatcacttccaagtgcacaagtctagttctaccctcatcatctgtcacccagataatcccagtaatcctctaacttaactagttcatctgctttctctcattgcagcaagtattctttttacaaaatgaaaatctgagcattgtacttcccagcttacatttcttcaaaggcaccaaacttcttagcttgacatacaaaatcctccacagtccactctcccaactccttcaagactcagttcaaatggcaatctgtgcggtcttccttggcccttggtcctctcaggtctagttgactacatcactgccttttctgtgctcccaaacttctattatagacctctcaccctgtagcacaattgtttatttgcatgtcttattcatctatgcatgtcagttcctgataaaaaaaaagcttgcaataaacgtgtgtgaaagaaatacatcagtgattattttaactgtaattattaaccaagtctagcttgacagctttctcacctattgaacatctcactgacctttctgtagtttcatgaaataataaggaacttttgcaagagagaaaactcttcattgactgtgattcttacatgctctgtctaaaacctctcacaaaatcaagtgctcctcttcaagtgtagtcttccctgggcaaatccttctccttgcccagaggacacatctgacctccactcagacccatgcttccatcattcctgttctcagagttacagagacatcatcagcaagttctgcataaaaccaagttacagaaagcatgcacaggacacctaaaatggaaacaccaggtccaccaacgtttgaacttcttggcaactttacatttggatctgtgccttcaagacctgggaggtgaagaaccaaacattcttgggggaagaaaggcaggtgaccaggcctgtcttccaacatttttttgtctagtagtttcatctgctttaaaaagctgtatttttccccagcaatttctatggatagagaatttgacaagtggtttctttatttcaaaaaatcacagcatggtggctgctttgctgcatgacctaaccaagagctggtcaactatgaatgatttaatatcaggttccctgtggggccaaatgtttactgaatgctcaccaagtgccaggaccttgcatgttcacaatatcctttaaatattcccaggtacctataaggtagaaattactaacacccattgtatagtccaggaaactgaagctcagagagcttcagaggtacacatctggaaagcagtcgagctaaatctctgagctgtgattccagaccatgtcccagtaccagaaagggtttggccacaggttaactatgtccagggaagttgggaaggggtagttggggtatggccagaaagcttctataataataggaagagcccagaattttgcttggcagccagtgatttaaatttacaacagtggcttcagctcagtttcacaatttaatctatccttaataccttaaaggaagccatagaaattttctctttataaaatgtgagaatagcatagaatttttgcaaatacataaatatttactaactcctcaaaagttattcaagatgccaaatatcccttcttgaagaaaccataaataaacctatatcatctgtcctacagtgaaaatcctcagagaatgcaatggcatattcaggggcataggatatggttttataattttccagctcatatttctttctttttttattattattatactttaagttctggggtacatgtgcagaacgtgcaggtttgttacataagcatgcacatgccatggtggtttgctgcacccatcaacccgtcatctacactaggtatttctcctaatgctatccctcccctagccccccaacccccagcaggccccagtgtgtgatgctcccctccctgtgtccatgtgttctcattgttcaactcccacttatgagtgagaacctgtgatgtttggttttctgttcttgtgttagtttatccagctcatatttcattggagacaaagacataataaagttatgtaagcagggaagagaattttcaattataaagattctaaaaagtaacaacattttagttgtatatttgtatggtatttttaatgcaatcaagctttacaaatgaatgcagtcaatatatcccaatattttgtgaaattccctctaaatagagcatgtaagacatccattaaagtttatttttagctaagagccaaaccctgtttcattttattatatccctcatcgagttttaacttagaaaacataaataaaacaagacattaagtgacttaataataaaagcttatcctagagtgtgtttcaggattgctttctacacccacccccaactactgctctcactaaatcattctttccaaatgtgctgagatgaaggagcaaaggtgtccttaagcctgacttttccttaaaaccatatattaaaagtttccctggtgtgctcctctcaaactaaaactggcttatgattaagagcaagagtggcaggcagtgactgagatgagaaggaaacactctaatttgtcatcaaaaaaataaatcagaaaatagcctttaatcttaagagtacaatttactgatttagtcatttatttacaaaattgatggaaattgttaacaaggagttaattgatttaagtcacctgattaccacagttaattaaccacactgacttaatcttctttgaaaacatcaactaatcatttcccaggtgtcaaggggtaaatcgttaaataaaaaataaacctctgtcctcctcttcaagagagatttcttgagtgtgttttctttacggattccaatctagccacaagccaagtttggggaaattttgttcttatatgactatactgaaagagctgccttctttccagaattttttctccgttatagtaaaggaaaggcagccttgcaagcttaccgtgagtgtcattttgaattacttcaaaaatgagcaaggaacactgcgtaaataaaaatgaacaaataaaaggcaacagagacattcatctgggaaggtcagttttcaaaaaaggaacttaaaacacactttattgggagggtgtggccacaaaggagtagcacaagggagttagtgggggtgattgaactgttctaatcccgaatgaggttgtggctacacaaatatatacatgcactaacatttacagaactgtgcacacacacagcaattttagcctatgttaatttttaaaattaaagcacttcataaaggccgattctcttttttacagatagaaaaatggaggtttgaccccttggccccacctcaaaaggaaaagagggggcggtcaaaaaaaaaaaaaaaaacgagcactgttagagaaactcagaaaaacatcctacatgactcttgtcgttcttgttctgagttagcagaaccactgcttctctccaaaaacaaaacaaaacaaaacaaaacaaaagtcaattgtctttgatccaccaatgtgcccatagaacaggaaggccctggagggaatcaaagtcccaggtcactgtgacaagtcacacttagacctcctaaagggaagaagtaactacagctttaataaaactccatcctcttcctatccctttctccttccttcaatcacagcaaaatgcttgaaaaataaatctggattacagtgggattttgttgcacatattcacaatcagcaacaactattaaagacccttttgatttcccttacagggaaacgaaagtgttcaatacaatatgatccttcttagcccaagtccctcttggtgccatgttctctcgtctgcactgttgggtttaattatttacagcaagaagcatctaacttccactgtctttcagttagtatgttcaatttttaaaccatgcattttgtttttcactagaatcttagctttcaatgattacttagcaaattctttcaacacttcactgaaccaaatattagggaagaagtaaattcttatatcagaagtgaccttgaaaaaaaaatgcagaattttggtacataaaaaccaatcatttgacaattgacttgggacatgtgtatattcaattttatgcatttgcaaattctttttttattacacagtaactttaaagaaaaacagagctaggcacagtggcacacaccttagtcccagctattcaggaggctgaggcaggagggttacttgagcctaggagtttgaatccagcctgggcaacatagtgagacccccatctctaaatttttttaaaaatagaaaaacaggattccctattaatagtaatcattatggtctagacaaattataactgccatgtatattaaaatccaagggtctcttctcaaacttaccaggcactgatgaatccccaaggaatggttgatggagtcttgcaactgtgttgcttttaacgacaacttttccttttgttgtaacaactcagtttcaattgctaactagaggaaggacagccatactagaagcttttaagttctatctttgaggccttcctaatagatcacagctgaaattccccataaagccattctaagaaaaagcacaagcataataaccctttattccccagaaaaggaagttggcttattttcaagactatatcacacctctagtaccttctttccctctttcatccccattaaaacataccagctttgtgtctccttctctctgaaccttgctctgacaaacatttactgtgcattactatctcaactaactactttaccctacaggagtgaacatttccacattgtaataggagtttcaggaggaaagaatgtcttactccgaagaactgactttagtaatgacagagcagagatctttggccgtagtgagagatactttgggaccaagagacctttaagcacatccagcacataggaaatgtcttctccatctctacaacagcagtgttctccgggaagtaaagaaactcagctctcacttggttgttcatttttttcttcagtgactttaaataagagaacttaataatttttttcattagtagtaaacaacaacaacctctgaaaatttatagatgactgctgtccctaacggaaggttaaaattgaactctctgattaggtaagggtcctttgaattaaaagacacataattatagagggaaaaaaaaaaaaggtgttcccagataatgaaatagtaatataggagaaacccagcagagagaaatcaatccgtacctaaaaagtacagtcttctagtcttctagaaggaagtggaaatatactctgttcaatagtaagttgttttggatgtggcctatgttgaaggtctctgtctatactctgcagtacctagttacatcacgcctagagcatgataaggctgcaacatatattgaatgaatgaatgaatgaatgaactgccaagagtagcaaaaaaatgtccaaaagttgggtcgcaatggtaccagcctctgaaatgaggtcatctgatcataatatgagaaattaaatgaggcttcatttgattacgtacagaggactatcttccacttgctccaaattatccatggtgacaacatatacaaataagggttctgggttcaaatgttggctctgccacttagtaactgaattgctttgggcaaattacctcacctgtcattgtcttggtcctttatccataaaatttttactgttactacataagtaggtaaactaatacctacaaaacacttaggccaatgcctggtatagaaagcactcaaataatttagtcacttttattgtggcttatttcccaacttctctactcatctatgtgtggaattccatcattctcctgcctccaacctatttgttacgtatggagtcctcaaaagaatggggactgagatgagggagactatgcccaggagacaagtggccatgggtccttttcagcagtcaggggccctcttcgtctgtgcccatttttccttcattcatcaggaacaagacccatgaatgtcctgacttgacatgtgatgttctttccaccacaatccatgctgcctccctgagtggagaaaccactcccctcttcaaagagggccttttgtttgatcaaggctgttttcactgtgtcatggtctcagacagctttcttttgtgttctgtttaaatacagaatgacagtccactaacacgaagtctaaaaactttggcttatctttttgtaaaagctactgtatcaaatctgtcctaaaaatagcagaatgacccattctgtatgtacaggggaattctcacagggtaaccaagtatctgggatggaagttaaaaagaaggatgcagattcaactactcaaatgcattgggaatcaccagcagggcgggagtgggaggcactggggtggagaaaaggggggagtcagatcgagagaaacagcgttgctaagccacttgctttgatagagacagcaattttcctttttctccatcaggaccttgactgggcctccaggggcctcgaggaattaagggctggtagtaccagggaatggtgatgagctgaggatgccccttcttagcacccatggtgacatctgtccattcatttattcaatgtatattcatttatttagcccttttctggacactagggaaagcaatggataaaagagatgaaaatccctgcccttgtgccatttacatcttagggaagggaagataataagtaaggaaataaacaaacaactaactaagttacataccttatgtcagatggtggtaagcgcaatggagaaagtaaatcaggaaagaagaggtcgggaaagaatcagagaaggccacactgagagggtgacctatgagcaaagacctgtaggaggaaaggaagtaagtcatgcaccatctgaggcaagagcatttaggaaaaaggggggcaagtgcaaaggcccaaaagtgctcaccatgtcagggaaaacaaggatatcactgtgcctggtgcactgtgcatggggagaggagaaggaaatgaggtcagggaggtgatgtgaaggccaaatggttagggtcttgtagatcatagtaaggacttggactttgactcttcatgagatgggaagcagtggtacacccagagttgtgccatgcagcttccccttataggaaggaccagctatgaggaaggactttcttcctgcaatcagctcctttggggtctgcctcagctatagaaagccacctgcccaaggtcgtgtccttccaggacaggccacatccagtgattaagcaaggccatttcagcctgacataggacactctaacaggcaactcttgctccagagcttcctctgggttgaccaacagctgccagagttcaacttcttcttctgcccatcctgcttcctccctttcccttcacacgcattgatcttaataaatattatatactccaagctccatctcagtgtctgtttttgggcaacccaacttgagtatgacagaaaccatgggagcttctgagcagaggggtgctgtgatctgactgatgttctaaaaaagttgctacagcaaggaaatcagtatggaagccattgcaatcgtcgaggcaagagagggcagtcggttgaatcagggtggcagaagtgaagatggtgaaaagtagttggattctagatgtattttgaagatcaaaacaatgggattttctaaggaattctatatggggtagaggagcaaaagaaaagtcaaagtaggatacagtttgaggcttgagcaaggatgaggaagccatttgctgagatgagaaattccacatggaaagcaagtttggacattagtggagatcaggagttcaatttcagacatgtgaagtctgagatgactattggccagccaggtggacatgtcaaatgagcagttggatatgtgggtctagactatagggtagtggtctggattagattcataaatttgaaagttgtcagcatgtacatggtaaagaagtatatatggagtcctcaaaagtatggggactgaggccaggcacagtggttcatgcctgtaatttgagaggccgagggaggaggatgacttgaggtcaggagtttgagaccagcctgaccagcatggcaaaaccccatctctacaaaaatacaaaaattagccaggcatggtggtgtgcacctgtaatcccagtttacttgggaggctgaggcaggagaatcgcttgaacctgggaggcagaggttgcagtgagccaagatcacgcctctgcactccagcctgggtgacagagcgagactccatcgcaaaaaaaaaaaaaaaaaaaaaaagtggggactcagatgacagagactatccccagaggacaagtggccctgggtccttttcagcagcctggggccctctttggttgtgcctatttttccttctttcttcaggaacaagatccatgaatgtcctgacttgacatgtgatgttctttccaccagagtccatgccgcctccctgaattgggaaaccactccctgcttcaaagagggccatgagacaggatgaggccaccaaggaggcagtgtagctagagatgaaaacaggtcagggatatagacaggaacaagcatgagataccaagggtaggccagcaaggaagaaaagaaaccaggagaaggcagtttcttgaaaatctaactaagtgtttcaaggaggaagtcaggatacactgtgtgtgatgctgctaaccagttaaataaggaccagagctgaaaatagatcattggatttaacaacatggaagtcatgagtgactttgaccaaaaaaatatctatcaaggatgagggctaaagcaaaatggcatggatttgagaaaaaattgaaaggtaattacagtggatataggcacatctgtacaagaattttactgtaaagtggaaccgaaaaaatagagtgatagttagaaggtaatgtggaacagaggatttcataaaagaaagaggggacaattgcagagaggtgagagggaatgagatctagaacatgaatgaaatggttggacttaagaactgggaaaattcttccagagtaataggaggaaagacagaagatataagacgaagttcaaatgatgatggttgagttatagaagtttatggaattctcttctggttgcttccattttcacagttttaaaaagctcactctacatgtgagaaggtgatgtcagaggtttgaggaaagaggagaagatataaggaagcaagagaggcaatagacagactaggaagcaagtcctaagcttgagattggcttcatgaatgtcaagcgaggctagtcagtatagttgtgtttttctcctgccatgtttagctacagagttgcagatgtggagaactggatttaaccaggatcagggccttgccaagcacaacagagccagataaaggggccaagctgctgagcgcgtatgtatgcagggaagtgaaattaatgatggccataaaatataagctgaggaagtaaataggtgagggatttgagggatggtgaagaggcggtaggatcaacaaactgtaagtcccaatgaggtcaacaaagagttgaggctgggatacaaaggaaatgagccatgaagtttttcaatacttccattccaagcatggaacagacagcttctctagaagccagtgggctgtgtcaggggtgttctgagatgaattcagattcaggtgagaaaagattagaagacctgcaacagttatttacctcaatgaatccaacgttcttaggagggtctggggggaacttcaaaggtgaccaaggtaagaacaaaacatacaattaagacacaaacagtggcatatttagggagaggttcaggacctgccatgctggccaaaaaaggaggtggccaggaatgagggtagtacttcatgtcaccctcagacttaaaagagtcctgtccttcttgttgtagctagcttgtaacattcccatccaaaagaaagagatttaacagagtatatttaactgccactgaagaaatttgcagtggtaagtcagttcacctctaagtctgtttacaaaactgaaaaatgagagggtacctagatcacacgttcccaaaaattggtccagccctcagaatcaccttgaaacttttaaaaatacagattttccacattttctttatctagtctatcactgatgggcatttgggttggttgtggcacatatgcaccatggaataatatgcagccataaaaaggaatgagttcatgtcatttgcagggacatgaatgacgctggaagccatcattctcagcaaactaacataggaacagaaaaccaaacaccgcatgttctcactcataagtgggagatgaacaatgagaacacatggtcacaggggggggaacatcacacacagagaggggaacatcacacaccggggcctgtcagggggtgggggccaagggaagggagagcattaggacaaatacctaatgcatgtgagccttaaaacctagatgaaaggttgataggtacagcaaaccaccatggcacatgtatacctatgtaacaaacctgcacattctgcatatgtatcccagaactgaaagtaaaataaaataaaatttttaaaaaacacagattttcatacccctgctttagtaagggtgagttttgatttaagaatctctatacttttttaagttcctcaggtgattttgatgatatgtcaagtttggggagctagctgactttgtctagggtccttagaaattctaacaatctgtaagttattgtgatgaaataatacttttgagaacataactaaaaccttctcaaagttggattccccctggataggatcaaggaaacacgtagccccatttgccctggcagccatatcagaatcatatgggaagccagaccgcacacaaaggtgaaacttaggggggagtagggtcaaggaaaacacaaagaaagagaactggagccctgactgcacctcgcctgaaccccactctgcctcagtattttttactcacataagccaagaaataccctttattgtgtaggccattttgagttgggttttctgtttcttgcaacaaaaagtattctccacacccttccccacatcaaaattaaaccagtgtggaagtacatgctagcatgtatcaccccccttctagtgagattaaaatgtgggtaggattgccatatttctgataaaatactttcattcttaaattcaactttaagaatttcctgacaaaataaatgatttcagccgggcatggtggctagcgcctataatcccagcactttgggaagctgaggcgggaggatcacttgagctcaggggtttgaggccagcctgaacaacatggagaaacctcatctctacaaaaaatataaaaattaactgtgagtgctggtatgtgtctgtagtcccagcttcttgtggggttaagcggagaggatctcttcagcctgggaagttgaggctgcagggagccatgcactccagcctgagtgataaagtgagaccctctctggcctgggtgataaagtaagaccttgtctcaaaaaataaaaataaacgattttgattttttcaacctttactcaggaaattttctccttgttaatgacataaaaaccaaagaactgggcccaaagtgacaagcaaatcactgacagtataagacagaatatttttatagaggaatccaagaatgtccagcataacagaagtgtagctactttccttttcgtctttttcaggtttcctcaacaccttcaaaagtacacatgctcttacttaatgtgaatcagtagatcagtgaggaaagacttattttcaaagttaccaggaatcttcatgtgttattcgctgatagtacataaatttaaaggagaccttggatattgcttacaaacttggatctcaagatctggacaataaatgcgccattgtatccatggtaacagtggctcaactattcaatgcacagaatggtaattacatttcctcctttcattcatttctcactgtttccagtaaccttgaggtcaggcatgacctgagggctaatgaccaaaagtgaaacttcaaattgtctaatctgtcattatctaggaaagacttacatttctttgcactgaatttcagtgctatcctaaatcagaagtgtcctaatataaaagttaaccatcttatttttagaatgataatgtctccattttctcagctaatgtgattagagataagacttaaattagagaccaacaaagtaaccatcagcaaagagtacatatatctggcatttctgaattaatccaataaggtgtgatggatacgtgttctaccatttatgaaagaagtccatagatgaagtgctaaggacactcagatgtgcaccaagatgtgttctgtctccacagaagcatcttaacctgtctgcaaactctttaagcttctttctctctaccccatccttatagcaaaggactagtgcttggaaaacagacaaactcttaggaacataaacattggagtgaagtaaattggaaaaggagtaggagcctaagattcacagaaaaatgaaatactgcaccagacttaagggatcctgtagtctgatcgctcagctcattttccagaactttcctgtctatcacaaagctctgctccaaataagaaaactttaggatccaaataaaccttctaaaagtccttctttctcctgttctccttctaaacttaaagttgcaacatggtcacatgggcacagatcaccatgtcttttttcttaatgtttccaatactttattcctttcaattctgtaagttaccccagggctgccagctcttgagaaatttctgtagctttttcaagtgtgtcttcacatacaaaatgaaaataacatcgtcagtcaattttatctgataaggtatactgaacacctgttatttttgcatcccagcctctgttcaccattctcccaataattacccccatttctctctggactccaccccttcatacatgatctcaaagactgagtatacagcccaagcctaagccatgggaacacatcatgacccgggattcagtggttggttctccaatgagtttatgacctaagtagagaccctgagatgcaactgaaacttttgctgggaatagctaagataaaaactctttttctttcccagtggatgtgatctgataggaggtggctccagagccactgacagccgctttacatcaaaggagaacatgtttaagaatggagtcatctcagagccaggagacggaaaaaagacaagattggcctgacatagtttgagcctccattttatattaggttgaaccaaatgaaattgccaatatttgactatttctgcataggaaaaaaaatcaatctcaaatggatcaacctaattatctgtatcttttcaactatgtatttattttctttgagacagggtctcactctgtcgctgaggctggagtgcagtggcatgatcacagctcactgtagcctcgacctcctgggctcaagcgatcatctcacctcagcctcccaagtagctgggaccacaagggcacaccaccattcctggctaattttttgtattttttgtagagatggagtctcactatgttgcccaggctggtctcaaactcctaggctcaagcaatccgctcacctcagactcccaaagtgctgagatttataggcatgagccaccacacccagcctcaactatgtatttcaataaccttccttttttgcctcagacagtttaacttagttttgtgacattcaccaacataacagtactgaataacatgtgaagttgtggtagccactgtaaggatgtaacaacatgcacaggtgcatcattctcagacccacggtaaagaagataccaaaatactgcaacatcttcctcctctcaagtttggaaaaagtaaaattctcgtattgggtaataatgatgaatggaaatctatatgagacttcacagtttattaaacatttcacattcattgcctttgcataaccaccccgtgaggtagatatatgtccattttacagataagaaaactgccccagagcacccagcatgtgtggtactggatttcccagataataaatggcagaggtaggaatcaaaccaagatcctccaacttcaaaatcacaagcccttcccacttcatctcaaaacactgtaactgtcaagaaattacttcggaaacatttgcattaggaacatgtgaagaaccacagaaatgctcttgacatttcaaaacaactactagctgatcattatcaagaagcatcccagaactcggatgctgaaacatctccaatctttctaatgctggtgagatcctgggcagggttattaggaatgagtcaatgactatttcagaatcttaaatgcaaaactgcagtccattttaattgcgagatatgtagacacctcttttcagttctcatcttccttaatgtttctgtagtattgatactattgactcatcagcacactgttgatatttaataaatattcatggaaaaaataaaataaacattcacagaatacacaatagtggtaaaaatttttaattactcaagactataaagttaataggatacgatagaaccatttgatttataccaaaggttccatcaagcttattttttccatgctagaatagggcttcacaattagtatttttttagttgctctagattcgtgcagtcaaccttgagaacccctttcctatccattcaacactctttcataagcaccttctactttcttttcttttttttttcttttttatttatttttattttattttattttattttattttattttattttattttattttattttatttttgagacagattcttgctctgtcacccaggctggagtgcagtggcacaatctcagctcactgcaatccctgcctcctgtgttcaagcagttctcctgcctcagcctcccgagtagctgggattacaggtgtgcgtcaccacgcccagctaatttttgtgttttaaatagaaacagggtttcaccatgttggccaggcaggtctcgatctcctgacctcatgatcctcccgcctcagcatcccaaagtgctgggattacaggcatgagcccccacgcccagctcagcaccttctactttctacttaccttgttctagctactaggacttaacagaaactccaaagccaatatgacaatgcacttgcttctgattacacaggaaatacatctaggttcctggtatcattatttttaaatgataatttaaaattttaatttaaatattttaaaaacctttcagtgttcttacagtgcctgactagagaacatgaacaatgattatgacctaataattacctttagtaagactgaaaacctagtcttacagcagcctgcactacaaaacccaaagatcttcaggaatgcgctttgatggctcaagaatttgaaaaatggatctggaggtatggtctttgggagtaggggcactgacatggcatcagttctggaccaagctgaaagcgcatggtacatggttgtaataacctatcacaggattcctctttggccagggacaggtaacccatccaattgtttttaagattcatctgcttatcagactgtgccttatctggcaagtcaggattccaaaaggaatctagaaatctcaaccaaccaaacaggctggggacattcagaaggcatgaatctaaaaaatggtccactgcaaatttatatcttagctctgtcacaggctagatgtccttaggcaagaaacctattaaccgccttccctttcatcctctcagcccctttcttctccctcctgggctaattgcttatctgtaagaaaaaaaaaatgcaagcagaccagttgatatctaaggttccctctagctgtaaaaagtctgagtttctattaaaatgagacaggtgcatgactgaagggagttcaggcagaagtcttatgaagactggtaaagagaaactttttcaagtagagaaagagaagccaacaactgtgaaattaaagcagcagtgaggttccagagttgtgatggaataaaaacgatacaagtttgctattgcccccacaatccttttaaacatataaacttcatgtgaagatgtaattgtcataaaagctgatactaactcttaaaaacattaccacatttttattggattaaagaatataatgttggaccaggtaaggtggctcctgcctataatgtcagcactttgggaagcagaggtaggaggatcatttgaggccaagagttcaagaccagcctgggcaacacagtgagaccccatttctatttttgaaaaataagtttttttaattagtaaacagaatacaactttgtttaaggccaatacgattttctcaaaaaaaaaaaaaaaaaagaaaaaatcttccaatcacatgctagggtctgagaagtcttcagagaactgttagtgaaaaatgcttaaagaagactttcctttgtatatttgaaaattggaaatggaaataggaataggaagcaaaacaatatgttactttaagggttgataaatataataaaaatattgtatttttagattattttctagtttattttcactgtctatatgctttacaccatgctaagcacttggcatattttatctctttatgcttacaagatgtcattgggtaaattctcttattatcttgtcaattttgcagataagccatctgagctatgcaaagttggttgactttcccaaggtcacacagctagaaagtggtaaagccaatgttggaacccaacagcttgactcgagttcagactctgcaaaatgttttttcttgaaaagcattacacaaaagataaggaaaatgcaaataatttttaacaacagatgtggtataatttttttcaaagactaaacatagaatactcagagctcttttttttcccctccaatttttagtgatgcgaagtttgcaatggtagcctacctaaaaggtagtgcttaaataaaggctgttacaatctcattggattttacttcatatattaagtcaggatcattacaacaggattctagaaatctcaacgtatcaggcagaggacattcagaggaaatgcgtcttaaaatgatcaagtaggaagactgggaatggggagacttgggttctggtcttagaaacctgaggagagattctggaaaaagatccacagttatgaagcagcaggtggtacgagttgcatattgcccctcagcttctttgggaacctcaaacatggacagtaagttagggagcatgacattttttgtacaaaagaaaaaagagaaatcgggccaggtgcagtggctcacacctgtaatcctagcactttgggaggcctaggcgggcagatcacttgaggtcaggagttcaagactggcctggccaacatagcaaaaccctgcctctactaaaaatacaaaatattagctgggcatggtgccccgggcttgtagtcccagctacttgggaggctgaggtgtgaggatcgcttgaacctgggaggcagaggttgcagtgagccgagattgcaccactgcactccagcctgggtgacagagcgagattctgtctctctcaaaaaaaaaaaaaaaaaaaagagagagagagagagagaaaaccagacactgtatactgtagcaattatagactctgaattcagaatcccttgagtttgccattttctagcagtatgaactgagacaaattactgaattgttctgtgcctccactttctcatctgtaaaacagtgataataagagtacttacttccaagggatattatgaagattaattgagtcaataagtataaagtgcttagaacaaagcctgccacatatatgtgtatgctaggttactattactatacacattattattatatattattatcatagaatggaagatggatgggtgcaaaaaactatcaagaagagtaggtattggttatttagtgactaaatcatcaacccaggaaaaagaatatctgttttggttgtacaaggacatagatgaatcaaggtaagatttccttttgccaggcactgacaggaacatatagtaaatcctatagctatatttaggacatgagatacaaccctaagcattgtgcaaactctgcacaataataataaaccctctttctgcgttaccaacactgagaaagggtgttcaaaggaaggttattaatgatctctccttgcctctcctgcctttctgaagacttttgcaagacctgtggggtttgttagggtttccaaacttcttcccaggaagtctgaaatgggtgctgctaggagttgctgtataattacttacttgattccctctaaggagcttacgctaagaattgaggaaagaaagcagattaaccatttgaatacatgccacggcccatccacaagccctcccctcactcctccgtaaatgggggcttccacattccccacccatcaaccccaatatgtgatccaggaaaatcaatttattgctttggctaatcctacaacaataggggtttcattttcattgtagggcaattaagttgtccgacgggagggaaggagcaggaggggaaaggggggactctcccatccccacagacagattagtccctgcggtggcagcagcgtcccctctgtctgtctggtggtcggtcacacgcagctcccggctgctacctagcaacgcaaagccagggggagagctcgccggttccagcctcctcctcgcccttcccattcatcctcggccgggtctctgtctctctgtctctctctgtctctctctgtctctctctgtctctctctctctctctctctctctccctctctctctctctctctgtctctctcctctctctcctctctctctctcttctcccgccccagtcgttctcttccctccttctttccttattcctatttgcttctcttacgctctctcctcttcccttcttactagttttattctctccgcttctttctccctctctttccctcttctctgtttctgttaaaacataaactatcggacaacttgagagaagtttaaagcacttcatactagaaactttctgcattcgatccccaaaactctggccatgcagacgggccccattcatcaacacaaaagcccccagctcccagctggaaaggaaaacttcaagaaaagactccagtccctcagccactctctcggccaatcccacctcccggccttatcttggctcgtaaatgatctgtatggtgagagcggtctctgggggtcaccgcgggaccaagtttcgccggtggtgggaggagtgctctggcccgcggccctgggcgcgcgaagggatcccgggaggggcgctgcaggtggaaagctgcgctctgagcagagcccgggaccgcgccgcccagcagagaactccgctagggagggcaggctgcaaacggcggagaacctcgttctcccgcaaagtgctttccaggagcatcggaccaacgcccgtgggaacaaagacagggtctccgtggggtgcgctgtcaccgaaactggcggggctgctttctcaagtttgctgccgctcagttcctggcgagcgaagaggggcgctcccgctccggcttcgcgaagcaacctgagcgccccaccgggagcagctcccgcgccgccgcccggccctagcccctgcccggacgctctcccctccggcctcccgcggacccgaccctgccacagccggggaagtgggggctccacgagaggctctggctgggctcttaccttggccactggccggcgctaggcaggcgacgagagccaggagcagcgtgcacgccactgctgccggcccgcgatccatctccgcgacggtccccggcctcgccgttccttccccgggaggtgggcgcgcgtagcacaccgcaccggcagcgcctctgctagcgaacgctcctttaggtctgcacctccgccagctcctagtggccaaaagcctgcccccacgcccgaggcatcccgttttctacccgcgccagtccccaccctccagacagtgcataaagccctttagacccgaccgccccggaacaagcatgcgggaatccagcgggcaggccccctgccgcccggcccgccccctgcactttgcagcgcggggaggagtgggcactcgaacacacgcgtgctcacacagggacactcacacaggcgtgtgcacactcacacacgcactcatacaggcgcatgcactcctaagtgtcacaccaactgacacagattcactcatacacgccagtcacacacgcgcgcacattccacagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcacggacgcagttttactaaatgagcaatggaaagaaatggacgaggaggaaagtcaagaatagagaagagaaagaaaaaataagaaatggaaaaggaaagcacaaccagacaagtaaaaatgaaggaaagagaaagaaagggaaagaggcgggggtagggaagggaaggagtaaagagcctgctggatggagatctgtgaccttcattcctggcctgatctctctaggctccttcggatatcttggtttcccctgataggatacaggctgctgagatggggtgctttgtgtttttacaaattagagagggaggtggatctttgttggggaggttggatccttatttagcaattattcagcaccacatctacaggtgtcatggccagatcgtgcttcttacaagtctgctcattttgaagcaaaattgaaaaagagcgaacgtcttctccatggttccggtacccttttataagaaggagaaacacgagaggttcagggaacccctagcctcccttctttggggccgctttggacaggctggcaaggggcccggaagccaaaagcacaagtggccttacacccgccctcagcgcacgtcctcagcctgtacgtgacatcagagcccacagggaggggtaaaaaaggagggttgatgcaagttatttcccggtggtgggaaccctgtgtgagaaggggctgtttgcgggcctgaggccatcccatcatctccagctccagcccctgaaccagcgcggcagctagtcccaggctccggatcctggtccaagaagtcaggagccctttccctccagcgaaggggccgtgacgcatggaggagacagccctgaacgcacgtggtcgctggacaggttcccgctgcctcccttccccaggggcgagaacctgccaattactgccagcccctttccccggggcacaggtcgtccggggctctgctgaccccaacagtccggatcgcgtagcttccgtgggctgcagtggtaggcgcagctttaggtgtgggggctaggggagggaaaggataggtgttactttggaaagacaaaaagagataaatagacacaaaaagagaaaacttaggcttaaagaaaaaaaggtggagcgggcagcgttgtgggaaagagtgggagagattcctggattgggaaatccagaggtctgtgctctggccaaagtcactggttctctatttgcctccctgcatagtgttgggcgctgtgcggcgcggaggagacaggactggggacaggagagccggggtctggggagggagggggcgaccggaccggagcgggaggagggaggcggcgagggggcttgatgctgcactccagtcttcgcgggtgatttatgccggttccgggcggccgaggcgatggtacgagaccgcgccggggtcaagccggtccgacgcccgctggggccgcgctgcatagtcaatgagcgtccccgcacctccgacttacaaagagcggccgccggctggcgggagggaggagcgcgagtgcgggaggggctgggctccctccagtgcgcccgtgggcgcgcaggcgcgagcgtgtgtgtgtgtgtgtgtgtgtgtgtgtgtgtgtgtgtgtgtgtgtgtgtgtgtgtgtgccctttcactgtagcagccagggctccaaacattcctttctgtactgaagagttcctcaattgttgttgtctttgtgctccagtgttgccaacttactggaattcctgacgtggttgcacagcagggctcaggctgaccgtactagccagctgcgtttgtgtatggggccgaccccgccgttaatcccagaataacgcagaagaggggaaaggagggagggagaacgggaggtaggagagcagaaaaggggtagggatgggggaccacctagcggagcacagcccatcattcgcagcactctgtatgtggacccacacacttttccactagaataacccattttctcaatgcaatccccaattcgtgacgtttgaaaacagcctgcaccatgcacgtgtttatctctggcatccatacctgagaatgcctgttactagattggggtgattaaatctatggaccagtatctgggaaagcccaggttaattcagttgcaatttaagccagcagtgtttctctataatgcaaaaagataatttctttagttttcacatttctctctccatatatgtatataggacttttcagagcagtcaaccgaaagagacaggtgaaagtgaaaccaagaagcttcagcaccaccattgccccagaagccaagctgaaatttacatcattcttgactccttcttttttccacccccattgccaatcaatcatgaaattctgttacctcaaatttatcaatccactcatcaatctaaattatagggagagccttagaatgagctccttgctatcagttttgccccctcccatctactttccatttggcaaccagacaattcaacttggtagttctatcaaactagtgcttgcaaacagaggtaattactttttagagggtaatgaaatcaatttagcaggtcaaggcaagaattatattcaaatgaaatataacaacatagaaaccaaaataactttcatgtggaaaagatatgtataactttataacactactgtttctgtgtgtgtgtgtgtgtgtgtgtatgtgtgtgtttcctcctgagtgcctcctgagtttcctcctgagagccaactgccccctgaacagctccaatccaatgtcctaaggcctcaaactcagcaggatggagcccaaaccaatacacacacacacacacacacacacacacacacacactgtgtcgccatgtaaaatatatttctcatatgcatctcagccaaaaaagtttaaagtatctccccacaaattacttattcattaaaaagggaaaaagtgactttaagcagaaaaatatgtcagatattttaatatgtttcattattatttaaatatgataaagtcaacagaccaaaagataactgccattgaaaatatagtttgttatattcacagatcccaagagaaggagtacacatcttgcctcaagggaccacacagggaagcagagggcaaggggagaagtgtgggcaagctcctttactatggtttccacctaaaggaacagacaaggcagagtaagcaggtttaggactgactaatttgtatttataaaacaagcaggaggtcaaagcaagatgactaatatgtcaggcatattaacagattatctagaacaaagtgtatatggcatgtgcatgcaggacagatgttaaacatgaagtttaggcccagcacagtggtttatgcctgtaatcccagcacattgggaggttgaggcaggagaatcacttgaggcttgagcctaggagttggaggctgcagtgagctatgatcacatcactgcactccagtgagaacctgtctctctctcccctatatatattaaggcattatatttatagaagctagaaatgtggtaaatacaataggctctacattgaaccaaggaatcaaagtcaacacaacaatcaaaactaatatgaggcaaactgacatcatgttcctcctggtgtgacacactctgaaggacacagcagcacttctgtggtattactgtgcatgccccaaatctaagcatgagaaaacatcagtcaaaccaatgttttctcattttttagaatgtccaaactaagggacatttaagtactaaagtacagtatttgcagtatattttgtatacttcaaaaatggcaaggtcataaaagataaagaaaggctgagatatgcagtttagaaatatgcagtgcatgaccctagggtggatcttggactgggaaaaaagtatctctagaggatgttatggggaaaatcagatatgcatgccctcagaactctctttacttccctcagcccagcacttgtcacatttgttgtgttcccatggccttctcaaaattcttctccctctgcaaccagaataatcttttttagtcattatgccaaccatacacttgcctgattacaacctttcaatcacttttccatttttccacaataaaatgaaaaatttttagcatagcctacaaacccttgcatgattgggcctttgacaatatctcaaactttacttgacagttcagccaccctggcctccacttggttcttcgaacatgtactacgtgctttcgcagccttgaaggtgagattaagatacgtaggtaaccctcccaagactaaaccaggaagaagttgaatccctgaatagaccaataacaggctctgaaattgaggcaataattaatagcctaccaaccaaaaaaagtccaggaccagattgattcacagccaaattctaccagaggtacaaggaggagctggtaccattccttctgaaactattccaatcaatagaaaaagagggaaacctccctaactcattttatgaggccagcatcatcctgataccaaaacctggcagagacacaacaaaaaaaaagagaattttcgacgaatatccctgatgaacattgatgcaaaaatcctcaataaaattctggcaaactgaatccagcagcacatcaaaaagcttatccaccatgatcaagtggacttcatccctgggatgcaagactggttcaacatacacaaatcaataaatgtaatccagcatataaacagaaccaaagacaaaaaccacatgattatctcaatagatgcagaaaaggccttcgacaaaattcaacagcccttcatgctaaacaatctcaataaattaggtattgatgggatgtatctcaaaataataagagctatttatgacaaacccacagccaatatcatactgaatgggcaaaaactggaagcattccctttgaaaactggcacaagacagaatgtcctctctctccactcctattcaacatagtgttggaagttctggccagggcaatcaggcaggagaaagaaataaagggtattcaattaggaaaagaggaagtcaaattgtccctgtttgcagatgacatgattgtatatttagaaaaccccatcgtctcagcccaaaatctccttgagctgataagcaacgtcagcaaagtctcaggatacaaaatcaatgtgcaaaaatcacaagcattcctatacatcaataacagacaaacagagagccaaatcatgagtgaacgcccattcacaattgcttcaaagagaataaaatacctaggaatgcaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcaaagaattggaaaaaactactttaaagttcatatggaaccaaaaaagagcccacattgccaagacaatcctaagccaaaagaacaaagctggaggcatcacgctacctgacttcaaactatactacaaggctacagtaaccaaaatagcatggtactggtaccaaaacagagatatagaccaatggaacagaatagagccctcagaaatgataccacacatctacaaccatctgatctttgacaaacctgagaaaaacaagaaatggggaaaggattccctatttaataaatggtgctgggaaaactggctagctacatgtaaaaagctgaaactggatcccttccttacaccttatacaaaaattaattcaagatggattaaagacttaaacgttagacctaaaaccataaaaaccctagaagaaaacctaggcagtaccatccaggacgtaggcatgggcaaggacttcatgtctaatacaccaaaagcaatggcaacaaaagccaaaattgataaatgtgatctaattaaactaaagcgcttctgcacatcaaaagaaactaccatcagagtgaacaggcaacctacagaacgggggaaaatttttacaatctacccatctgacaaagggctaatatccagaatctacaaagaactcaaacaaacttacaggaaaaaaacaaacaaccccatcaaaaagtgggcaaaggacgtgaacagacacttctcaaaagaagacatttatgcagccaacagacacatgaaaaaatgctcatcgtcactggctgtcagagaaatgcaaatcaaaaccacaatgagataccatctcacaccagttagaatggtgatcattaaaaagtcaggaaacaacaggtgctggagaggatgtggagaaataggaacacttttacactattggtgggactgtaaactagttcaaccattgtggaagtcagtgtggcgatttctcaaggatctagaactagaaataccatttgacccagccatgccattactgggtatatacccaaaggattataaatcatgctgctataaagacacatgcacacgtatgtttactgcagcactattcacaatagcaaagacttggaaccaacccaaatgtccatcaatgataaactggattaagaaaatgtggcacatatacaccatggaatactatgcagccataaaaaaggatgagttcatgtcctttgtagggacatggatgaagctggaaacaatcactctcagcaaactgtctcaaggacagaaaaccaaacaccgcatgttctcactcataggtgggaattgaacaatgagaacacatggacacaggaagaggaacatcacacaatggggcttgtcgtggggtggggggaggggggagggatagcattaggagatatacctaatgtaaatgatgagttaatgggtgcagcacaccaacatggcacatgtatacatatgtaacaaacctgcaggttgtgcacatgtaccctagaacttaaagtataatttaaaaaaaagatacgtaggtcagagaggcagaggtcatggagttgcctcagttccttacggctctctagatctagatcctaacctagcgtatccttacaaaaattcccccttttgcttgaataagcttgaattgacctctgccctttgtaaaacagagctagactgaaatgatcaacaattgctaagaagacatcataaggcatctcacctactagtcagctccagtatttataatacttttttcttgaagcctttttaaaaatagcaataataactttggactcaccagcctgaggaccaggttctgagccataaattaacagcatatctctggtgtgcagccagggccaggaaagccacagcaagatctgaaaggacagccagtgcaacagacatattttccacaaacagaaatgaagacaccaggtataatatcacaagggaatcctcttggtttgcaaataaagttatatgacaagtcttggcaaaggtttaaagaaacaacagagactctaacaagtctcactgattgaaaaaaagttaaataaaattaaggctttccaacaacaacaacaaaaaatccaggatataaagacaccattgcaggaagacctgggattcagttacctggggctaaggccatcacaaatgctgccatcagtccaggatcactagcaccagagtcaagaccctgtgcagggagatttcagagtacacagtaaggaagcctaggaataaagttaagaaagtcaaaattgttaaccatactacatttaaattcttctctctcaagagcagtttatgccagtaaagatcagtgaaaacatctggctagatgagtcttgatggccagaagaccaagatgattccatcagtctcactgttcctcttttatctcagagactgaaaaagtgctaaaggtatagaaagacatatgataaggagtagtatatgcaggaagaaaacacctttgtttagtcagaatgcacataggatccttcaagtgaaatcaatgaggacaattacttcaaggtcaccattacttgtaaatccagtctttggtgttcacaggtttgggaacgtgcaccagaattcagccaagctccctatcaaaggagtcaggtctatctttttcaccaccaaatccccagaacctggcaaaaggcccaatacatggcaggtcctcagtaaatgtttggtgaatgaataaatgaaataagacagcacaaagtctacatttggcttttggcatttcaaccaaatcagaatctagatattgaacagacttcacaggatacaatttatgctgaagtgatcttgagatcttgagtaccatggaaaaacatcctcagggtgtttcaatttgaatttctccttagtcatacttgccttcaggacctacagttaactttgcaacgtgagttgaaatagagcagtgtttctctaatgtccgtagaggacatttggcaatatttggagacatttttaattatcacaactgaggagtcctgctgtcaactagtgggtagaggccagggttgctgataaaacatcctgcaatgcacagaacagaccccagaacaaagcattatctgccctcaaatttcaatagtgcaaggttaagaatccctgaaatagaacaatagaattttaaatattttgagaacaaagtatttaagttggatttcagacctagagctcaagaacaaaatcataaaatgcatttagaaaccacttctgctaatttcctttttctagtactggacagtacagtgggcaaaggactataattctgtagatcaaagtccagtcaaaagaaacagacatatctcactttcaagtgggagctgaacaatgagaacccatggacccagggaggggaacaacacacacgggggcctggtgggtggtggggggcaggaggagggagggcaacaggataaatagttaatgcaagctgggcttaatacctagatgatgggttgacaggtgcagcaaaccaccatggtacacgtttacctatgtaacaaacctgcacatcctgcacatgtatcccagaacttaaaacgaaataaaaaagaaacagacataagatgcagcatgccaagaagcatttcaaaatagagaagctgcatattggttcctacgcttcagtgatgttaaaatgcaaactaaacaagaaaaatatttctttcccctctcctctctggttgaacaactgctatttcttcctcaagccctacctcaaatgtttcctctttggtggcgaaacctcctccaactctcccagagcacctctttcttttctataatcctatcccacgaaacacttaccttcattaggattctcaacatgtgaaataaattctttgattacttttatgtgtcccccaataaactttgtacttcatggtcttcttttttaaaataaactttttaattgtagaatagattgactgaaaattacaaagagagtccaga

SEQ ID NO: 1136 - DNA, 22006 bp, Homo sapiens
gggcatgaggtcagaatggtgaacacagaataactgagaatcatctcttagttctacccacagattttacagttgagggaaattttaccagttcctgaaaaagtggttcgttaagggggctagtcttttgagacatcacacgaaaacggaaggtgagatagactggacatttgagggagaaatattccaaggaaggatcttttttgttgtttattttcaagaaataaaattgaaggtaaaatgaagatgcttaaagagacaaagataggccaggtgcagtggctcacacctgtaatcccagcactgtgggaggccaaggtgggcagatcacttgaggccaggggttcaagactagtatggccaacatggcaaaaccgcatctctacgaaagatacaaaaattagccaggcgtggtggcacatgcctgtggtcccagctattcactgaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaaccaacctagccaacatagtgaaatgctgtctttactaaaaatacaaaaattagctgggcgtggtggcacacgcctgtaaccccagctactcaggaggctgaggcaggagaatcacttgaacccgagaggtagaggttgcagtgagccgagatcgcgccactgcactccagcctgggcaacagagcaagcctatcccaaaaacaaacaagaaagggagagatagtgaaaacataagcaagaagtggggagagaatatagtaaagatagaggaagtgggatagagtacagataaaaggatcagtcttggaaacaagaaaaagtactgtgagtcagtatgtaaggaaagattaaatataacaaaattaaggaaaaagagggaagtgagatccacacttgatggccttaagctcaatgaaatattaatagatgagagtgaagaacatcagaggcacggagatttagaacatcacgcacagtagtataatggggagtcaacaaagaatgagtaaaagttgtgtccaagaacactgatgactctctgagattagctggccaggattagttataggcctcttatggtgactcagctgtctactgcagcgcttggcagcctaagacaaagccccaagaatgagaccacttagtttacccaagtcaatttttgagacagagtttcactcttgttgcccaggctggagtgcaatggctcaatcttggttccctgcaacctctgcctcccgggttcaagcgattctcctccctcagcctccagagtagctgggattacagttgcccaccatcacgcccagctaatttttgtatttttagtagagatggggcttcaccacattggccgggctggtctcgaactcctgacctcaggtgatccgcccaccttggcctcccaaagtgctgggattacaggtgtgagctacggtgcccggcggtaagagattctaaaatgcagacaaagtggagttgaaattgttgaccatgcagtacatgttaaatcaacaagcaaaaccaggaaagcagaagcagccggaagtcttggtaagaataaagaactgattcaaggggaggcagagagtgggagatgtgaaaagtgagtggttgtgatgagaagggtaattcagagatcaagatcttgaaggcataattcttccaagtgatgctggggtttgaggtacaaccttactcctgggtggctaaaatggaggagggaagaagaggctgtaaaaccagtagacttgagaaacttggagaattgagaggccagactgtaagactcatctgatctgtgtggcttctttttttatttttatttttttcctctgagacgaagtctcgctctgtcacccaggctggagtgcagtggtgtgatctgggctcactgcaagatccgcctcccgggttaatgccattctctcgcctcagccttccgagtagctggggctacaggcacccaccaccacgcccagctaattttgtttttgtatttttagtagagacggggtttcaccttgttagccaggatggtctcgatctcctgacctcgtgatccacccgcctcagcctcccaaagtgctgggattacaagtgtgagccactgcgcccagccgatctttgtggcttttaaagtcactaaagatggtggtaggaggccgggtgcggtgggtcatgcctgtaatcccagcactttgggaggctgaggcgggtggattgcttgagctcaggagttcaagaccagcctaggcaacatagcaaaaccctatctctggaaaaaaaaaaaaaatacaaaacttagccgggcacggtggtatgcgcctgtagtcctagctactcaggaggctgacgtgggaggatcacttgagcccaggaggtcgaggctgcagtgagccaagatcacgccactgcactccagcctgggtgacagagcaataccttgtctcaaaaaacaaacaaacaaggatgatggtagggataagatgtggagaaagactgagctagttatacaagttgttaagagcataataaatattttgatggataagattgtgctgtgaagacaggaaaagcatggcaaatgcaaaaggcacgtgctttgggagatgaggaggagtttatcagtggtctgggggagagaaaataacgacccctctcttctgccttcattcccctagtgatggaggtcgaagaaagagcaaccttcaccacagagaggagtagcatcattaggggaaagccaggtttcaaaatgcccagaggaaaatgctttcaaacatagaagacaggatttgaaaatgtgaagagttccaccaaatattgtgaaatggattggtagaagggtccttgtggggtagggaattgaatccagggaggttaaatcccagtgggaattcagaagactaagtctggagagtttagcttctaggagcaggaggttgttgcctctggaattcagaatggaagatgcactgcatccattgtgaggggaaacaagtgcctcaaaggggtcttatagggatgcacaagataagttccatggctttaaacaccatcctcatgctgaccatgcccaggtttctttctctagcttggaccttgcccctgaaatccagatgtgtatctgcccagtggcatctctacttgcatgtctaatagacttagacttaccacacccaaaatagaattttttagtttttccatccatcagaatcctgcttctctcccagtatctacatctcccacccatcaatccatcatctagtcctgttgtttctacccctggaatgtataatatatcccaaacttgtctacttctctccatctccatggctgccactattttctcttcaccatcaatgccactgccacctgtctcctaccagccagcctaaacacaggagccacagtgatcttttaaaaacaagtccaggctgggcgcgttggctatgcctataatcccagcactttgggaggccgaggtgggtggatcacgaggtcaggagttcaagaccagcctgcccaacatgatgaaaccctatctctactaaaaataccaaaattagccaggcacggtggcgcatgcctgtaatcccagctactcggggggccgaggcaagagaatcacttgaacctgggaggtggaagttgcagtgagccaagatcatgccgtagcactccaacctgggcaacagagcgagacgccatctcaaaaaaaaaaaaaagtccaggcaaggctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgaagtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcacctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacaaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacacacgcacgcatgcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttaaggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcacgtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggtttgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcgcagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacctatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttttaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctctctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcgggtgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccgaactgccggacgtggtggcatgcacctgtaatcctaccactttgcaaggccaaggtgagaggatcgcttgaacccaggagttccagagcaacctgggcaacatagtgagatcctgtctctattttttaaaaaagaatgaaacataggaataagatgtgggtgaaggactcacatgccggcttggtcccactggtctttgtggtgaaggaggggagaggtgagaggtgggtaatccggaaagagaaaagcaccccctccctggatgaaggctcttctggagagagtcaaagacaaataagggtggggcgcagtggctcatgcctgttatcccaacactttgggaggctgaggtgggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaaacaaatatggagacggaaattgagcccccctagactgggagcccccactgagttcggaaattaggctttacctccagccctggggtgccaggcaggagaaaaccatgtggtaggctgagggggtagggtgacccattggggtgacctagatagggccttgggtcaccctctgcctcctccagcctgtggctgaaagtcagccatgaagtaatgggggacactgttactcatcccagaagcacccacacttactcacttttgggaagggggacctaaagtgtgaaaaaaaggtgaggattttccgtctcaccctaaatgggacaccctaagtggggcatcggtttttcctcctccccagaacttcctggtgttttcaggcaccacaggctccttcctgccatccccatctctctctaatattctccccttctttctccttcagcctcctcccttcagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtttgagaagtcccccttcctcccaccctccaactgggctaatggtggggcctggccattcagaggcagggagggggtgggacaggcagaccatcatccctaggagcaaaggccatacactgtgttgtgatgaattgtttcaagcaaccagaagagtactgagaatatttaacccgcacccgtgcacccaccctgaattaagacgtgtgtcgcaactcagcatctttatcggcagcactgaagctttccattctttattttcatcaggttcaaaatcaatttccaaacagtctcctacatttttcccactgccatggggtcctgggcgtccgggcccccaatattcacgcactcgcaccacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccctgggggtccccgccgccagggggcgcccggccccggtagccgacgagacagtagaggtaatagaggccgtcctgcgggagcgccagcccctcggcgtccgagaactgcgtcccgctcgtcagaaacgcctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttctgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaactggaaccttcggattatttacactcttattcaggtcttggaggtccttacctatgaggtgggcagctgggagcccggggctgagatctgtttctggctcctcctctggcagcttctgaaaccctggaaggggcaaagagtccacgattgggggcagggcagccacccatgcaggctacccttgagagaacagggcgcagggatggggagcctggattcctagaggaagaggtatctggggacgcagcagggagctgggagcccctgagggtctgaagcggggaaggagagacagtctgctcttacccagtccttgctgggcctgtgccccggggtcggccgtctccgttacctggttgggtggggtcacagtgcccagagttcagattcagctcatgtcacccctacccctctgaaagtggacccaagctgcaggcctggggtttctcctaccagcaccatccccaacacacacctccttagaagggagaacaagcaaggcataggtacttgggcggagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcaagatacaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccctccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagagaaactgaggcccagggagggaaggtagcttgcaggaagccagtcagcagagctgaaatgagaacacagatctccaggtttccaatgtggtttgcattcttctataccctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacactttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctctcaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtctcgctatgtcacccagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaagtgctgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcg

SEQ ID NO: 1137 - DNA, 80624 bp, Homo sapiens
cacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatgtaagaaactacaagtgactagtcctagctagagcccacacagactctagggtcccaaagcctgagctgggactttgctgccctctaagggtggggataagtttgcagtttcccagctaggacgctgggccgtggagccgggatggggcctgagacccccttgtgcctctcttttggagctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgaggagcttctgggtttggaggaggtaggggtccagattccaggtcctggatctggaagaggttccttgggggtttttactttatatataatctcatggttaagttcagaggctttagagctaactaaatctgactgatctaagtgtgaattttgtctctaggcctttctgagcctcactttccttgtttataaaatggaaataaaaattatggttgtcataaggatcagtgcatataaaaggctcatacagtacctagaacataatggcacttggcaaatgagggctactcttctcataaaagagagactggagtttgtataatgaagggaatgaaggtcactgagtgcccagggcagtggctgagtcagggagaacatgatgtttttcctcgggggagagcgttgaagcactttcctgtatccagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgagtttctggggctggagtggggaagaggctgaggggaaagagggggccagggtgtgacccaaaacaggtgcctgaacttgcaggggctaactgatccctaagtatggatcccagtatctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcaggtgagaactgagatcacacagggattggggttgggtggacagatgcttctttttttattttttatttttaaaaattgagggccaggcgcggtggctcatgcctgtaatcccagcactttgggaggccgaggtgggcagatcaccaggtcagtagatcaagaccattctggctaacacggtgaaaccctgtctctactgaaaatacaaaaaattagtcaggcatggtggcacgcgcctgtagccccagctacttgggagatcgaggcaggagaatcacttgaatctgggaggcagaggttgtagtgagccaagatcgcaccactgcactccagcctgggcaacaacaacaacaacaacaaaaattgagatagagtcttactatgttgcccaggttggtcccaaactcctggcctcaagtgatcctcctgcctctgactcccaaagtgctgggattacaggcgtgagccacccaccatgcccggccaagtactttttttttgtttcatttttttttttagacagagtttgctctgtcacccaagcaggagtgcagtggcgtgatcttggctcactacaacctccgcctcccgggttcaagcaattctcctgcttcagcttctcaagtagctgggattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatgtttgggtggctggtaagggaaggctcccttgttttttgaagatagaaaattggaatgctgataggcttctctcagctgctccagatagacccctgtcctctgttgctttaggtcagtggttttcaaactgtattccaaggaacctgagagatatatggaatggcaccttggaggagaaacagggaggcacaggaatgtccttcatctttactttagccaaacaagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctactttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgacaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcacgaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgaggcggggctgtcctcgcggactgactggactccatctcccagcgggcgccgcggcgcggccacgcccccccactccccgcgcgcgcccggtggaggtaaccgcggccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgaccccgtcgggtgagagtctctctgagcaacccaaacagaaggtactgctgtgggtcccccacttggcacgcgacggcgctgggtcggcctggcgcgccctcccgcgcccacgggcgctaggctaggtctgtgcgcagccgctgtctcccgaggtcggccccgccccgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatatttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacgctggaccagtctgtgctgatgagcttgcaaggtcactgcctggggaggtagaggaggggaggagagcctcctgttgtgttcacgtcagcagagatgtcatatcgctctctggttcctgtggttttactgtgagatcctgtccaaaatgagggacgaatccaaagggttggttagcatggctatttctgctgaaaaggcatagataacttaaaagtttgtgaatcctaaatctacctctgggtggagctgatggtgatgtcggacttcagcagatagatatgcattttgagctggatgcttttggaatacaggaagataggaaccagaggctctacgttagtaaacatggttgaggcaagaggcagagtcggagcctcgttggttgtgaagacaagagtgtgagttgtgggtgatgttagaggatttagtctttagaggagttaaaggtgttagtctttttggggaggggagagaggagagaatgagaaggaaaatcttagttatctttgcaatctgaataactgaaggcagtggctgctgatcagatgtgaactctggctaaaaatttatcctaccacccgtagctagaataataacaagatctcagggtccttgtggctctggaaggaaatgattgtgagtgacttgagtttcgtcagatagttgtcagtggagagggactgagatcccaccaaggctagagaggcctgatgcgtactcagtaggaggtgcttcaggcctgatctttgagattttggttggagagggctccgggttttcaatgtaaacatagattgcaaggtgtagtctagagctctggttctataaattctgttttactttaagatactttggctctcactctagtcatttctacataattcttttttttttttcgaatcccatgacaggttaactacataattctttattaaaacaaattatgctttttactcatatcccatttcatttctctatttctctcccccttggattctgctcaggaggagctgagtgcggctctgttatagtgccccacctcctgcagtttgctcatgactctattgcagttgggagaaccaagggactatttgggttcgttaagcagtggtgatacctagaaatgaatatatggcgtgctcagaaacctggtggtgttctagagatatcactatcaaaagccagaattaggacgaagtacaaactacagacagatgagggagaagacaacctaattcttagcaggtactgtcagtgggagaagtgtctctaggttcgaggagagtgaattgttatgggccttggctgactctggagtagcagctgctagcactgtgcggtcaccaagcaggggaggggctgtggctctgctataaatagtgctgggagccagagtcgctatagagataaaactgaatcctattacctgcaggtcctctactgggagcaagggaaaggagaaagcagtattttgaggatttgagaggtattgcaaataggtcttgtttattgttaggtaggggagaaaaaacttctactcattacctaaaccaaatagggccttaagcatccagggagtgtgtatgtctgtatatatgggagtgcccgcagcagcaggtgagggagtagagggtgtgtgtgtgtatacgataatgggtttctctccgtgtgcattgaacaaggtcttaggccgcatgtagagcacagaggtagaatcctggaacactagaaatatgagaaaagaacttctactcatagaagaagtagccctaccagaaatagctgtgcagcggggtgaaacgttttatttagagaagtgtatagacacttaacacgaaataaattataattaagaccatgaaagcttttcctaattttaggacatagtttagaaatttctctgagcacgtctccctgtccttgcagaaatcctggtatttctgcctctaattcatagcctctgtaatgtatagtaggacaaggactcatctgtgggtattgtattactgattctgagcctgagatcaaaatagaggagagattatgattcagcaccaagggcagagctagtagcagtggcctctgggctcctttcttgcctgaaggagggagaaaagtggtgcagattaggcaattggggcatggacattttcatttgagatcacatgaggtagaatagccagctgttattgtctgagcatggttaactagacagtctatgtggtagttttacatcaagctgaatgtagattgttgaaacagaataattaagtttccatctagacctagaagtgcaggttagtgctagctagttgaggagtctggtttgatcctgatccaccctggagggatcctgagagtgacttcaatttttgttacaatgactgagtccagattagatggcctaggtctgtttttcagaaacagagccccaggcgttaagctggaaattaagtcattggtagggataggtaggtgaaccattatttatctacatttttttttttttcttgagacggagtctcactctgtcacccaggctcgagtgcagtggtgcgatctcagctcaccacagcctccacctcctgggttcaagcgattctcatgcctcagactcccgagtagctgggattacagatgtgtgccaccacacccggctaatttttttgtatttttagtagagatggggttttgccatgttggccagctggtctcaaactcctgacctcaggtgatccgcctcggcctcccagagttctgggattacaggcgtgagccaccatgcctggcctatctattttttaacattcgattctgtgagctcatgagcctagacacgaggctaggcaagcgtcaagttctcctatcattagtatgaaagtggaagaccttctgacctctgcctctggccgggaagaagttgagagggatgagtcccttaggcacagcagtggatcttatcagtactttttttcctattagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggtaaccaagaagagattgacttttgtcttaatatctgggatagccataaaatctgcagttgttcccttctccgatttccatgttgctttgcatagctcatcttctcctgttattttaccctgatgggagcatcgaagccagtagggaaaaaacaaaatcaggtggattgaaagcaaaaccctgctcttaactaacatcttcttgatgtcgagcaaatatactctttatacctcagttttcttattttgtaaaaagaaaaagtacattataagctactcctctatgtatacttttttggtaatttattagttaattcactttaaaagatgttaatcatcttaaggtgccagtgataattttattgtcaaaatctccccttcgtttcagaatagatgccttcatgacagtgtagacttcacttaggttaccagctccatgcggcaggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaaggtacagtttgctgctgatgcctaatgggggaagcatttagagattccatgtaattggtctttgaggggcataggaaatttcctctacagctcaaggtccttcagacctattaagcatatttagagtatttagagttaatcttttttcttttggagacagtctcgctctgttgcccaggctggagtacagtggtgcgatctcggctcactgcaacccctgcctcctgggttcaagtgatccttctgcctcagcctcccgagtagctgggattacaggtgcacgccaccatgaccagctaattttggtatttttgtagagacaaggtttcgccatgttggccaggctggtctcaaactcctcacctcaggtggtccacccacgttggcctcccaaagtgctgggattataggcgtgagcatcatccccagccaagagttaatctttactaagcaaaagactgctgcagagttagacctctttccaaaattgtgtttggagtaatgctggaatttggtgttttaactgtggttaggacagtaagtcttacccagtatatatctttacatttgcttttgccattgtatatactttccggtcctatctgagctcagagactgggctttcttaatgatgctccgtttcccattgtcatcattagagcctctgtggtgatactgagttgcagtagggtatcagcttctgatgctaatgtgtctgattcctgctgtctgcttctcagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtgagaggcaagcttcctagacctttctaggggagaaactcttaaatatgccagtggccagaccacgagctcttagaggacagggactacatatttttcacctttttgtcttcaggaggtaacatgatgcctggtaaacagcaggtgttccgtagatgtgggttgaattaagatactggtatcatgtgggatgtatttagagggtttaccattcattagggcttatccttaattgtactgacctaattctttggaaatatcagtagttctgtttcagtgagtggtcctgggatgggcagtacaagaactaggaaggtaagggagtgatttgcatatctcaggtgactgaggatcaccattgtgcctggattgggaggtggcaggcatggtggggcagggggcagtgggagagacaaagctggagctgtaggctcgatgaagtggaaaccaagttgtaatgttggaagctgttttcttgtaaaccatattttatgttttggagtgattcttactggatggctcatgacaggtggtgctacagtcccgagactacaatgcactctccatgtctgtgatggcattcgtggcaatgatctacccactggagtatatgtttcctgtcatcccgctgctacccacctgcatggcatcagcagagcaggtgagtctcaaggcgacttccggctttctcacctctgtcttcctgagggaggaggcttaatgctcaaagaagttgtaagtgagtgctggtcctcaatcctttgtcataacttatttgtctacaaaatctgactgatttgaactgatctggtggcaaggcttatgctattttagttttcatttatcacaacaaatgttaatgactgtaggccactggctacactgcagcaggtgttacgtgtgttacgtaatacagtagttcctccttatctgtggaggacacattccaagacccaccagtggatgcctcaaaccacagatagttccaaactctatagatactttgtttttttctatacatatataccggtgataccgtttaatttatgaattagacacagtaagagagtaacagttttctctttgggcatatatttggtgttttttggagacagagtctccctctatcccccaggctggagtacagtggcacaatctcggcccactggagcctctgccttccaggttcaagtgattctcctgcttcagcctccctagtagctgggattacaggcactgccaccaccacacaccaaataattttttgtatttttagtagaggcggggtttcaccatgttggctgggctggtcttgaactcttgaccttaggtgatccgcctgcctcagcctcccaaagtgctgggattacaggcatgagccaccgtgcccagcctctttctacatatatttggcttctctttggcatatcccaattgccagcatcagtacccttgtgctttggggccattattaagtaaaataagggttacttgaacacaaacgctgagattgtgtgacagttgatctgataaccgagatggctacaggctggacacaggggtgattcatgtctgggtgggacagagcgggacagcatgagatttcatcatgcttctcagaactattgtcctgcacttcagatatgatcaagctgcagtttaaaatttatgaattgtttatttctggaattttccttttaatattttcagactacagtttgcctcagttaactggaatcacagaaagtgaaactgtggataagaaagactactgtatacaaaaaaatgtaccatgttacctttcaaaaaatctgaaaaattctgaattttcaaatacatctggcctcaagagttttggaagagggattgtatctgcatttccttatctagaagaatccagacttgataagtgctcatgataggttttgtctttgtttctcaccttctttatcatttccacagctgctgttggctccaaccccgtacatcattggggttcctgccagcttcttcctctacaaactggacttcaaaatgcctgatgatgtatggctagtggatctggacagcaatagggtgaggttcttggctgaggcattgtagagtctagaggaggattgcattctagacccagtcctgagatatctgtttctagattcctttcaggaacgtcctaagttgttggataatttctattgcgagacttactgaaacaagtttttttaaatgctccttttaccttattagccaaataaacccttggttaggtctcagagaattacaggatttatttttgccagaattaagtgaccccccaccatatcctccaagagcagtcagacagttgtgatctgagggccattacatgtggtatagatcatctcttaatggtttccctggggtatagtttccagtaagaaactgtctttcagtgcaggcttaattaattatatgaccattctgcaatgtgaatacattcagactttggtgggaagcccttatgtgtgctcattgtaaaacttaaaaaaaataaaaataagcgtaaataaaataagtgaaaagaaaaaccataatccttttatctagagataataaccaataacattaagttatatttcatttcagatgcatatgtatgtcatatatgtgtgtacatatatcttactgtgcagttatataatgtatattcgtttatataataataatgtatatacgtcctcttatttttatttatgtaagtgaaattcctgagcaataaactctaaggtcacgtcttttatcatttctctggtgcaggtgattgcccccaccaatgcagaagtgctgcctatcctgccagaaccagaatcactagagctgaaaaagcatttaaagcaggtaggtgaagaacgaaggaaagaaaggggagtattagatgctgtgggattcctataagaagacagctattctcagagccaatttcctatcaaacttcaagtggagtagttttcttcaccctggatgggcttaagaaaacgcgtatcccatttctgggtggcagagtgaatttctgtttttgattccaattcattgtatgctttaccatcttctaatgcttatgatgctgtataaaatagcccttcactctctgtttcttgtatgtgtgccactctctatggcttcagaacattttctcagtctttttttttttttttttttgagatgtggagtcttgctctgtcccctaggctggagtgcagtggcgcgatctcggctcactgcaagctctgccttctgagttcacgccattcttctgcctctccaggagctgggactataggcgcacgccgccacacccggctaatttttttgtatttttggtagagacggggttttgccatgttagccaggatggcctctatctcctgacctcatgatccgcctgcctcagcctcccgaagtgctgggattacaggcgtgagccactgcgcccggccgattttctcagtcttgttaggtggaagttagtagtgtggaccgtctggctgcttttatattatcttctagagttgatcctgagggttcctttcttcaaaaattcctttatttggctgggcacggtgcctcatgcctgtaatcccagcactttgggaggccgaggcaggtgaatcacgaggtcaggagttgaagaccagcctggccattatgttgaaaccctgtctctactaaaaatacaaaaattagccgggcatggtggtggacgcccgtagtccagctactcaggaggctgaggtagaagaatcacttgaacccaggaggcagaggttgcagtgagccaagattgcgccattgcactcctgcctgggccacagagtgagactcagtctcaaacaaacaaaaaaattcctttctttgagtaattcctcacatccattttttattgattgattttcttcttcctctgcatgctgaacacagtacctgaaggtaacacatgacaaagcttcattcccttcctctgccttatgtgttgtacaggaacaccagtagataacactgtgtttatttttaggaatccctgctctcatttgaagggcctttagaaatctttttctgtgttgtctgaagtacttagtagtatctctagatgctatgtttgggtttaaatgggtcattgtgtttcatccctctcacctcagttgcttcatcactgctaatataatatgataccttgttactgcagagtctagtgggaattttaagttcagaaagttctctagctgccttcacttgctgtgttttcagtcttgatgattgctttagtatgactaatgagatggagaggttaataaatggaattatatttaattaaattaattaattaatttatttatttattttgagatggagtcccactctgtcacccaggctggagtgcagtggcacaatcttggctcactgcattctctgcctcccaagttcaagcgaatctcttgcctcagcctcctgagtagctgggattccaggcacacaccactgtgcccagctaatttgtttgtatttttagtagagctggggtttcatcatgttggccaggctggtctcaaactcctaacttcaggtgatccacttgccttggcctcccaaagtattgggattacaggcatgagccaccgtgcccagccagaattatattttaaatgtttgtaggagctaagatccttggactcattgatcctgtgttctaactcctgctattcaaagtgtggtttgtgaaccagcaacattagcatcactcgggcttgttaaagtgcaggatcactccaggcatattgaatcgggatctgcattttaacagcctcccctggtgattcttctcctcactcacatttgagaagcactgctgctctcgaccagtggtcttcacgctgccccattgagcctctgaggggccgatttagcttgggagccctgagcatttgaggctctgcttcctgtgtccttcagagcagctctgttttcaaatttccattctatataatttcacatagattccaattttaaaaaacatttaatgactataataattttgcaaacgactgtcgtggacttcagataagatcaagttgccttgagctaggttgtcttaagatggagagctacatatttcaaactgttttctaaaggctagaatattgggatttttatttcaaagatgaaaggtctgaaatgggttggccgtgatttgcaaattagcaccgttctttgttgcagaactttttgaccagagaatacgaggtagcagaccttaggaaggccttttccttggagttaagattggctagctgcccagggacgttccttgtgtaaggaattttcttgttgttccacaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccaggtaagaccaagccgactgtataatcacaagttcttaaattaatttctttgctctctaagggaccttggggcagactatttctctgaaccagggttccttttttttttgagatagattctcactcttgttggagtgcaatggcataatctcagctcactgcaacttccacctcccgggttcaagtgattctcctgcctcagcttcctgagtggctgggattacaggcgcctgccaccacgcctggctaatttttacatttttagtagagacggggtttcaccatgttggccaggctggtctggaactcctgacctcagttgatccacccgccttgtcctcccaaagtgctgggattacagccgtgagccaccgcacccagcccagggtttctttatgtataaaatatatactatatttggttgttattttccaccttagtaaaatcaaagtgaagaaatagtaaaccacgtgctcaggatgaagagggggctgatgattctttaagatatctctccccttgatgttggaagcctgttaagtgatggctttgggaggtgttctaagactttggatcatgggaatccttaccctatgggtctcagattatctcatcatctgcttccccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacagtgagtctacctgccctctgctccgctctgccttgtgcctctgtcctcctgatggactttgatttttcctttgctaatgtttgacctgtgccttctatcctggctctgctttagactttttcctgcctttctttcaggcgttgcttgcctttttttccttgctgctgactttctgttcttttccctcatggggtagatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgataggtgagcatccttagggcagcaaaaaggttttaaaggtgaggaggctctcactagcccttctttagcacagagaaggcaaagtctcataggcttcccatatcagtgtttttaattttattttattttatttatttatttttttgagacggagtctcgctctgtcacccaggctggagtgcagtgacgcaatctcggctcactgccagctccgcctcccggcttcatgccattctcctgcctcagcctcccgagtagctgggactacaggcgcccgccaccacgcccggctaattttttgtatttttagtagagatggggtttcaccgtgttagccaggatgatctcgatctcctgaccttgtgatctgcccgcctcggcctcccaaagtgctgagaatacaggcgtgagccaccgcgcccggccttatttatttatttttgtatgtatgtgacagagtcttgctgctctgtcacgcggtctggagtgcagtggtgccgtctcagctcactgcaagttctccctcccaggttcaagtgattctcctgcctccgcctcccaagtagctgggactacaggtgctgccaccttgcctggctaatttttgtatatatatattttttgagatggagtcttgctctgtcgcccaggctagagcgcagtggcgtgatctgggctcactgcaacctccgcctctcgggttcaagcgattctcttgccccagccacccgagtagctgggattacaggcacatgccatcacgcccagctaattttttgtgtttttagtagagacaaggtttcaccatgttggccaggctggtttcaaactcatgccttcaagcaattcgcctgcctcggcctcccaaagtgctaggattacaggcgcgagccactgcacccggctactttttgtatttttagtagagatggtgtttcaccatgtttgccaggctggtctcaaactccagacctcaggtgatccacccgccttagcgtcccaaagtgcttggattacaggcatgggccactgtcccggcccccatatcagtctttatgctttggttgactgtttttcttggcttctttatttgatttgttccctggccttgagttcggagtgctcccccttttatttttcctggtgctgattgtaggtgttctccctgcccctttctgttttgtttgttttttatgcacttcactctgcagtggcagtgatagtatggattatgacgattcaagctcttcttactcctcccttggtgactttgtcagtgaaatgatgaaatgtgacattaatggtgatactcccagtaagtgtgcttggggagattggccagccctgggcaggggttgggggcccaaggatggagtggtctgtacctgcctcccttggattttggcagatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgtaagtgaggagcggtggatgagtgagaaccatggcctgggatgtgggcctcatctattaggaaagccaggctgtagctattcatttgctgcttctcacacaattttctcatcttcctcttcatgggccctagagcttagagcctaagagacctacttttgaccccaaaaggaggtcatcaggctttgttcagggtacagctatgatcccccttatatagtttgtggggacagagaacgggtgctacagagatcatttcccacacattccttaggctagaaatctgacaggcctggtccagccctgccaaactgggattacaggaaggtaccattgggcaccaggtaaccacttttaatttcatgcggcctttaggaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcggtgagagcctgggcatcccttctagatgggtgactgaaggacctcacctcagtggaccctgggcaagggttaatcagaaagtctgagaagtctgaatgctctcgtggtcctgccatccccagaggatggtgttctgatccaggggcttaggaattacgggaagggagtggcaactgtagtatagcataattatggcccatactcccaagatcaggtacccctgcctggggatcataggtgcctctgtgcattcaagggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagtaagtgccttcagctgtctctctcactcctgtgttccattttctctacagcagagcctgactatggcaaatgttgcttagaacttcacatgtagggctaggttggcattagcaagccctaatccagtcatttgggtgatactgaataaggcgttttcaagtgaggtcagtaaaggacagggacagattagtcattatgcctggacatttcagtctatttcaggtaagacagctggatgggtaactggaaaacaggcagtaaattcaaaatcacacacttgtacttatattttgtggaaatactctggtcaaatttgatttgagtccatatctggtatcttctttgcctcataacggactcttccatgaatgtgctttgaaatcgatatgagattgaattttgtgcttagatagtattcccagcagtgcagggtcgtatcagctaaagattgaagacagaccatggactagagagagcgaacgtagaggatccctgtgattgtgagtttcttcagcagccagggagggacagtgccagcttcagaccagaagcctgttaactgccagctttcatgctgtgtagcagtggatgagagacttggatattatcatgtgaggtggacagagaaagctgttactgggttttggctgatcctggcagtggctccattgtttgcctggagttagacttgatcctttctaagacagatcagagatgatctgatccaccaaactgggattgtgtttgaaaaggagggaggtgcagatgctgatagtcattagtctactgctttgattacttactctgccaagtcatcgctcttgcaccctccccttgataggcagcctctatcggaaccacagtaccagcttcagtctttcaaacctcacactgcccaccaaaggtgcccgagagaaggccacgcccttccccagtctgaaaggtaactacagccttccttttgccaagccaggtttctccgggagatgtttcgggctgtgggttcatgtcaggagccctgcatctgctgaatcctttgacctggttgtcgtccctcatgttgctcctcatggctttcaccgcacatcctgggctctgatggttgtcagatggaaaccatctttgtagctagagacggccctgttatgtcatttaggacaatggcaactgtgggattactgctgcttcgcgggaggaccctgtcagggtatatgattaacatagggatcatcagctgcccccagtcgtctgctgggttgccactgcatgaacttagggcaaattccgtgccaaggagctggcccaccagagaatggttatggagagcctggcagcgttcatagagcacagcctctcacctctcacgcactcataagcctgtcaacccagggcttaatgagtgcgccaggtagtattggttagtttctaggggcagttaaaaccttatgtgaaagccaggcgcggtggctcacgcctgtaatcccagcactttgggaggccgaggcgggtggatcacgaggtcaggagttcgagaccagactgaccaacatggcgaaacgccgtctctgctaaaaatacaaaagttagccatctggtgtcacgcacctgtaatcccagctacttgggaggctgaggcaggagaatcgcttgaatccaggaggcggaggttgcagtgagccgaggtcgcgccactgcactccagcctgggtgacagagcaagactccgtcttaaaaaaacaaaaaacaaaaaacgaaaccttatttgaattggtttgtgctatctgacagtttcaggggcttttctgaatttgattttttattttttttattttctgagacagtgtcactccgtcacccaggctggatggagtgcaaggtggtgatcttggctcactgtaactgccgccatccaggctcaagtgattcacatgcttcagcctcccgtgtagttggaattataggcacataccacctcgcctggctaattgttgtatttttagtagagacggggtttcaccatgttggccaggctggtcttgaactcctgaccttgagtgatctgcccaccttggcctcccaaagtgccaggattacaggtgtgagccactgcacctggcctgatttttttgttttctctggatggtatgacgaaatatttaactgtggtaggaagtgcagtgagaaacatgtatttttttttttttttttttttttttgagacaagagtctcgctctgttgcccaggctggagtgcagtggtgcaatcttgcctcactgcaagctccgcctcccgggttcacaccattctgcctcagcctcctgagcagccgggactataggagcctgccaccacgcctgcctaattttttgtatttttagtagagacaaggtttcaccgtgttagccaggatggtctcgatctcctgaccttgtgatctacccgccttggcctcccaaagggttgggattacaggcgtgagccaccgcacctggccaacctcatgtattctttaactgacctctcattcctagtggtaaaaaatgtcaggttacttgggtgcagtagctcacacctgtcatcctagctacttgttaggcagaggcaggaggttcatttgagcccaggagtttgaggtacagtgagctataattaggccagtgcactccagcctggacgacagagtgaaaccctgtctctaaaagaagccaacagaaacaaacaaagttgtcaggagtctaagacatgttcttaggtgaggatgggaacattggataaatgggcaaaaggacatcagagctggcagtgaaaggagcgaactagcactgccagggaatccacatgtggccgggtaggctaaggatggaagggtgtcagtgtcactggccttcatttggtacatttgaagagaagagcgattgaaactctttcattgcatgctgatgctttgtcgcatttgctgcacttaccctctcacccatctcccatcctcataccctgaccccactccccacaacagcatctgcaagatgggttgcttccctgcacataccctcaggcccctggccctctgtgctggatgttttctgaaaaccagcggtccctgtttcatgcatgtgtgtgttcagtacctgaaggctccctgtgtcatttacccgcccctggcttgagaggccagttttaagggtggtcttttcttagagccttggttgtctcctggtcacttggcttccagctctgaggtgcccaagaaccaaggttatgtgcattcctcaagctttgggagaatgctcagattatctggcttactgctcctcggaggggtagaggggttgcggtattgtggtacacctactaattgtgtattttgtgtcccagtatttgggctaaatactctaatggagattgttactgaagccggccccgggagtggtgaaggtgggtcttgcctgtgagctgtgcatgatcttttttttttctctagcatcttctgtgcctgcccgagggccatccttctcatggagcaagcagcgtcacatgagtgacctgcttgccccgtcccccgtgacgcccatgcttgcccatggggcttgctgctggtgcatgtggagtggcctgagtctccatccccacctcctccacattgccatggctggtttctacctacgtatgatgccttggtgctaccctcacccagcccttctgaggaacgggcatggaacatggctacttagggctgtgctggcatgagctcctgtactacaatagtgatgtctctcattcctgccttccctgccacaggaaacaggagggcgttagtggatcagaagtcatctgtcattaaacacagcccaacagtgaaaagagaacctccatcaccccagggtcgatccagcaattctaggtaataaatggtagagctgttttaaaagttctcaggcagaggtggggtggttcctctacagaactttagggatgctcaagagtgggagagaagctctcaatggggtagatgtaatcaatttcttgccagcacttctcattctggcttgatctccatgcaactgaaagcttacagtgttgaggggggttaatcagcagcggtgggtatttggacaaatcgcgtgctccagagaggtggggatgtggtgcacttggacattcagagacatggctttgtgttttacccctggaggcagacatctagtctgggtgaaaggtggggggtgctctgcaaaggagctgatgaccacagaagcggtgtgtggaccctgtagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggtcagtgttgggggtagggaatcggagtaactggagagagggatgtgaacaccacaggcaatttgccaacgctagcccctgggttattgttgcaggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaaggtagggatcgtacttgctgggcaccacgccatccctaactctgccacttgtctcctgaagagaaaatatatgtgtacccaggacacgtttcccagtgccacgctgcttcccattaggctttgggattttattttctaatgcatgtttatacgcagtgggtattctttgttacgaaaaataagacatcagctcatctttccttgaacttcttccattccgcaccctcctgtatcctggctcctcccacctcatatctgcgccttgattcctactcactacttctcttgacctcttgatatttttccctcagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattggtacgtatcagtgtgtttggtgtggtggaggggtcctggcttcttaaatatccctttctcctcaattcatccagaatcctgcctttctctgccccatgctttgcttcttagagagggaagggggcctgtgtccatttctggtggtgtttctttgtacttctctagtctttatgcttcatccacagccaccccccaccccgtatcttagatgaagaatggtaagttttgtttagagggcccaatgaggcttactgcagggggtgtgagctgtactcctggcccctccttttatttacgtctgcatttcttcacatagtggagagaattcctggaagtgctcaggaagtttatagatgcatttttgggctataaaattatgacatttgtgtctctgaagccagtgtcctcccatccaaccattatactcctctggaatgtgctcctctggggcatgcctggcaaccccatttccctgggttctggatctttgaggtataggtttccaagtcagttctttaaatgcttcttcactggacttgattataatctcgtttacatttggtgtttctccgttcccacaaaggcagtgccttagtgagctttctaggcatcacctctgtttggctcactccctgcttgaccttgagtcatcgaggttggatctttctttttctggttctaggtccctaggcactctgcttccagctgacatctcattgccatggccattagcagttgccatatgctcccataaatggtgacatggaaccagattcctttttaggggagctacacttccctagccagcagaatattattctagtagcagtcaactcctggctttctcctgcctcatgtgatgttgtagaaaatgtactgacctgctagtctggagatctggagttttagtcccatatcagcctccaactaggaatgcaactttgggcaaataacttcacctctcagggtatctgtctcttcatctgggaaatgaggaaatcatactaagtacactctgaagttccttccaggaaaagaattgctgtggttgccattctgtctgcttttccctatgaagatgctggtcttgaccattttatgttctctgtcacctcaactggaggcatttttccagatcactggtgggtagggcaggtaggggtgagttggtttcttgaggagcaatgaggagggatgctaactgcctgcatgaattggcctttgttcagtccagtgaatcaagcaaagattggtgttcttccttctgaaactctggctgcttgaggtgttcatctgtctcatctggaatctgaaaaattgcccttccccagctcatttggtagagagagtgtgtggcatggtgggagtttaaatggatcctaagttacatgatcttgatcaagtgctccagcctctttaggaccagttcctcatgcaaaaatgaaggagctttgttaagggcacttccagctctaacattctgcagggtttttactgccacattgggattggaattagaaatttggaatctgttcatgagtttgggtggaggggttagatctcttgttttctgccccttctccccatgaagatatctttgtatctcttggttggtaatccagtgcctgagactgaatcgacttgggtgggtgggtttccatttcgtctgtctgaccagcctctgactttctgtctttctctcctgcttgcattgcatctggggtagaattgtggaacaagcaccaggaagtgaaaaagcaaaaagctttggaaaaacagagtaaggaacaaatgccctttcctgttcccaagtcctccatacctgccaactccccaggcccagttggggcaggctccctttgtcagccccaccccaaatttgctcttagagcgtgtttggaatggcagcaggtaggtagcatgtgactcctaggtgtgtgtaggccgcttctttccccctcccctcgtgtcaatcaggctataaccaggtgtctactgaatacaactccccagaacttggttctctgttgcttcagagttggtggggagaatgtttgcctattttagtgccccccattggctgatatctcccacacctgttagaaggcctgtgggcacagttggcagagatggttgctgtccctccatgttgagtctgtagctgccccactctctggtggcttgcctaggcacgctttcttgctttctgtcattctgtctttctgccataccattgtgggtgggtgggggacaaggggggtggttttcatctcaaacatagaagttgtaggatggaggtaggcagtgcccaccaaaacagctggtgtttcttatctcatcgggcccaaccttttctacctcctttagacacatttgtttgggaagcattaagggacctggggaccattaaatggtttcaggtaccagtgaagctcagactcttgagtgccatggaatgtggtttagacatttgttcgtggagcttttctttttttttttttttgagatggagtcttgctctgctgctcaggctggagtgcagtggtacgatcttgcctcactgcaacctctgcctccagggctcaagcaattgtcgtgcctcaacctcccgagtagctgagattacaggtgtgcatcaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggtcctctttttccagtgggtcctgagtggggggtagtccttggaaaggtgactaggatgggctgaacgggtctgggaacagcctgtgctgccgtcccaccccctttaccagcctgcccctagcctttgtgcacggagtaacagaagtcttcccctactcagggcctgaagtaatcaaacctgtctttgaccttggtgagacagaggagaaaaagtcccagatcagcgcagacagtggtgtgagcctgacgtctagttcccaggtttgtgacaaccttgttgaaatttgcaagtattaaatatgctgtctcagaatacttctttaagttaaaatagaacagtcagacagccgggcacagtggctcatgcttgtaatcccagcactttgggaggccgaggcgggtgggtcacctgaggtcgggagttcgagaccagcctgaccaacatggtgaaaccccgcccctatgaaaaatacaaaattagccaggcatggtggcgcatgcctgtaatcccagctactcgggaggctgaggcaggagaaatgctttaaccggtgggcggaggttgtggtgagccgagattgtgctgttgcactccagcctgggcaacaaaggtgaaactccatctcaaaaaaaaaaaaaaataaaaataaaaataaaatagccaggtgcggtggttcatgcctgtaatcacaggactttgggaggccgaggcaggtgggtcacttgaggtcaggagttggagttggagaccagcctggccaacgtagtgaaaccccgtctctactaaaaatacaaaagttagctgggtgtggtggcgggcacctgtaatcccagctacttaggaggctgaggcaggagaatcactggaacccgggaggcagaggttgcagcgagctgagattgcgccactgcactccagcctgtgccgcagagtgagactccgtctcaaaaaaaaaaaaaaaaaaaaaaaatgaacaacctcaaaacaatataaataactaatgataagggaattattaaataagtataatagatccatgtaatgcaatattagtatccattaaagattgtgttttcaaaaatttagtgacatgggaaactgtttaacaaagctacctatagtgtgactccaattttatttttaaaatgtattgagaaaaaactgaaaggaaatatactaaaaacagtggttaacgtgggaggtagatttacagcttgttcttatttccttattctttcatgtattttctacagtgagcatgtacttctttaacgcattgttttttgtttttttgtttttttttttgagacagggtctcattctgtcgctgcagctggagagcagtggtgtgctctctgctcactgcagcctcaaactcctgggctcaagtgatgctcccacctcagcgtcctgagcatctgggaccgcaggcacccaccaccatgcctggctaagtttgtgtattttttgtagagatggggtttcgccatgttgcccagcctggtctccaactcctgggctgaaatgatcctcccacctcagcctcccaaagtgctaggactacaggcgtgagccactgtgcccggcctatttcttttttttattacataagttgtacatattttatattctggaaacaaaagttgctcgtgacttctctaaggatgataacagaagggtggggatgaggagaaagaaaaaggtacagtatttctgtgggaaactgagaggagattggacacctcccctaatgttcctgtgtcttgtttcagaggactgatcaagactctgtcatcggcgtgagtccagctgttatgatccgcagctcaagtcaggattctgaagttagcaccgtggtaggggaacaccacactggcatcttggtgggtggggtgtggatttcccctttggaaaagggtgctactttctctttggaggctgctctgagtctcaggtcagcatggttctcatggtggagatgtttaccatcataggtgtgtgtatacgagatttcacccagagcttctcatcttataaagaaggtacttccagaggctatctgacacacttttgaaatttaatacttttttatggtggcagggagctctaacagcttggtatttctggggcccatccctggggactgtctcttactaccttttttcctttccaggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttgtaagctttgtttattaacaaaagaaaaccatttctttaatgggggagggaagcaggcaagaaaagaatgaaagttaagagacgctaaagaggtaaaggttaaataaggaagaggtaatcttcttatatttggctttaaggaaaacatttcttaaggctttgttcagagtcatttgactcacaatctggggcttttagaaccctctcctgaatcattgatgagttaggctccgtgcccagtcacgtaagggctttgaatcctatgtagtattaacccccaggtttaacacaggcaaagtaatacctttgtggcaatgtcaggacaattacagctctcgtttagtaccagtctgcctatttctatggactatccagttttattttggtcactgctctatttataaataaaatagcattttattttagtatattcctaacagttatttgaagttttcattcattaataaacatccatgaagtgatttactaagtgccagattttgtgctaaagaaacagggatgaaaaaggcatggtttctactcaagaagtttgtgattcactatattgctgtgagtagtctcttctaataggtgaggggaacaatgccttaggaaaaaagaacttccctagatcacacagtaagcccatgatcagctggaaggagatgaattctttttagtccttgccgtagacatctgttttttgttgtttttttttttttttttttttacacagggtctcactctgttgcccaggctggagtgtagtggcacagtcactgctcaactgctcactgcagctttgacctgttaggctcaagtgatcctcccacctcagcctcccaagtagctgggactgcaggcatacaccaccatgcctggctaattttttagttttttgtagagatggggtttccctctgttgtctaggccagtctcaaactcctgggttaagtgagcctcctgccttggcctcttaaagtggcatgagccactgtgcccagcctctgctttttaatgtgtatgtgcctctataggctgtgttaaaacactgatagacttgttactttattaaacagagatgagaatggatgttctctacaagagcttatacgcataggtccttatctttaaggcctatggggagaaaggaagataaaagttaaatgaaaccaactatttaaaactggttatcattcccacccccagagccttctgtatgtgtgtttttaatagagtcagtgacctcccagagtggagattgggaataggactgagaggctactcaagttaatgggccttaactctctctcagtctgaacagactgattggctgattgagtgattgatttttcttttgtgctgacagtttattaggggttttcttttcttttcttttttttttttttgagatggagtctcgctgtgtcacccaggctggagtgcagtggtgcgatctcggctcacggcaagctccgcctcctgggttcacactcttctcttgcctcagcctcccaagtagctgggactacgggtgcccgccaccacgcccagctaattttttgtatttttagtggagatggggtttcaccatgttagccaggacggtcttgatctcctgacttcgtgatctgctcgccttggcctaccaaagtgctgggattacaggcgtgagccactgctcccggccaagggttttcaataatgttttcttttcttttctttctttctttctttttttttttttttttgagatagaatcttgctctgtcgcccaggctggagtgcagtggcgcgatctctgctcactgcaatctccacctcccaggttcacaccattctccttcctcagcctcccgagtagctgggactacaggcgcccaccaccatgcccggctaattttttgtatttttaggagagatggggtttcaccgtgttagccaggatggtatcaatctcctgaccttgtgatctgcccacctcggcctcccaaaatgctgggattacaggcatgagccaccgcgcccggccttctttacatattagttcaaccttcaccacaaaatctaaccatggatcgtaaaaattaaattggcaacggggctagcctgctatacttcctgtttacttttagatgcttttcaaaccaataaggatgacatttgtggtggaaggagccagagtaataggaaaattacttctcttcgcttagaagaaaatcctccaccttgagcatcttctgaactttttactataagacatctcagtgcttgcttgtactcttcagccgcataactgtgaagatagcaaccatcagtttctcataaatggaagcggcagtgagaaccgtctacagcagtttggcttcaaggcctgtgtagaggcccattattccaaaacacctgttagccatttgtatgtcttcttttgagagagatctattcagctcatttgcccatttttaaatagattatttgtgtttttttgctgttgagttttttctttcttgtatattctggctattaatcccttgtcagatgaatagtttgtaaatattttctcccattctgcagactgtctcttcactcatttcatcgtgtcctttgttgtgtagaagctttttagtttaatataatcctgtttttgcttttgcttttgttgcctgtacttttgaggtctccataaactttttgcccagaccaatgtcctgaagcatttctgctacgttttcttctagtagttttatagttttgggtcttacagttaagtctttaatccattttgggttgatttttgtatatggtgagagctaaggggtctagttttatttttctgaataatggatatcaagttttccgagcagcatttattgaagagactgtccctatccccagtgaatattcttggttcctttgtcaaaaaacagttggctataaatatatggatttctttctgggttctctattctgttccattggtctatgggtctgttttttatgccagtagcatgcagttatggttactatagctttgtcttatattttgaagtctagtagtgtgattcctttttgtccaggattgttttggctatctggggtcttttgtggttccatatgaattttaggattttttttctatttctgtgaagaataccgttggtattttggtagggattgcattgaatctgtagatcacttttggtagtatggtcattttcacaatattcgtccaatccatgaacatggtatatctttccattttttccctatactctttcttacatcagtgttttttatttttcctcatggagatcttttacctccttcataaaagataaatttctcctaagaatttattcttagggcattaatttgtggctatcgtaaatgagattgccttcttgatttctttttctgctattttattgttggtatatagacacactactgatttttatgttgattttgtatcctgcaagtttattgaattcacttattagttctgagttttctagtggagattttagggctttttttttttttttttttttttttttagatggaaccaggctcaagcagtccttccatctcagtctcccgagtagctgggactgtaggcatgcaccaccgtgcccagctgatttttgtattctttgtagagacaaggtgttgccatgttgcccaggctggtctagaactcctgggctcaagcagtccacccgccttggccacccaaagtgctaggattaacaggtgtgaagcacaacacccagcctaattttagggacagtttgacttccttctgtccaagttggatgccctttatttctttctctggccaattgctttgattagcatttccagttgaataaaagtggtggaagtagacatccttgtcttgctacagattgtagaggaaaaactttcatctttccccattcagtatgatgttggttgtgggtttgtcatatatgacttttattgttttgaggtatgttcgctctgtacctaacttgttgagagcttttatcatgaaggaatgttgacttttatcaaatacttttgtatttggtattcgttcttctttaaatgtttttagaattctgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccgcccgccccaaagtgctgggattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctcccaaagtgctgggattataggcgtgaaccaccgtgccctgtgatgggaagctttttattacagattcaatctcattacttgaaattggactattcaggtttctgtttcttggttaaatcttggtaggttgtctatgtctaaatttatccgtttctaatttgttggcatatagttatagtctccagtgattttttgtttttctgtgatgtcaattgtaatgtttacttttttgtttttggtgttttcttggtggaggtcttttcactctctctctttttttttttttggttagtctagctctaatggtttgtggattttgtttatctttacaaagatgaacttttcattttgttgattattaatttatttattttgagatggagttttgctcttgttgcccaggctggagtgcagtggtgcaatcttggctcactgcagtctccacctcccaggttcaagtgattcttctgcctcagcttcccaagtagctgagattacaggtgcccaccaccacaaccggctaaatttttttttgtatttttagtagagatggggttttgccatgttggccaggctggtctcaaactcctggcctaaggtgatccacccatctcagcctcccaaaatgctgggattataggcatgagccaccacgcccggcctatttttttaagtctcaagttttatttctgctctgatcttgattatttcttctaattttgggtttggtttgttcttgctttcacaattctttgagctgcatcattaagttgatttgaaatcttcctacttttttgatgtgacgtttattgctataagcttctttcttaatactgcttttggtgtatcccataggttttggtatgctgtgtttttatgttcatttgtgtgaagaaatttttaaatttccttcttaatttctttgttgacccattggtcactcaggagcatattgtttaatttccatttatttgtatgattttaaaagtttcttgttatttatttctaattttcagagcacagtgttcctttgtggtctgaaaagatacttgctgtgatttcagttttcttaaatttctcattatacttattttgtggcctcatatgtggtctgtcctagagaatgttctgggtgttgatgaaaagaatgtgtattctacacctgttggatggaatgttctgtaaatgtctgttaggtccatttggtctaaaatgcaatctaaatgtaaaatgtagtataaatccggtatttctgtgttgattttctgtctagatgatctgtccaatgctgagagtggggtattgaagtccccaactgttattgtattggtgtgtatctctccctttagatctaataatacttgctttatatagctgttctgtgttgaatgcatatatatttgcaattgttatatcctcttattgttattacataattactttctttgtctctttttaggttttttttgtgtgtgtgagacagagtctcactctgtcgcccaggctggagtgcagtggcgcaatctccgctcactgcaacctccacctcctgggttcaagcgattctcctgcctcagcctcccaagtagctgggactacaggtgtctgctgccatgcccagctaatttttgtatttttagtaaagacagggtttcaccatgttggccaggctggtctcaaactcctgaccttgtgatctgcccgcttcggcctcccaaagtgctgggattacaggcgtgagccaccgtgctcagcctctttttagtttttgacataaagtctgttttatctgatataattatagctactcttgcttgcttttggtttctatttgtgtgaaatatctttctccatcccttcactttcagtctgtatgtgtctttgctagtgaaatgagtttcttgtaggcagcatatagttaggtcaagtattttttttttttaatccattcagccagtctaccccttttaagtgagggaatttaatctatttacattcaaggttgttattgatagtgtggacttacttctgttgttttgttaattgttttctgattattttgtatgtcctttgtttcttcctctcatttatcattatggtttggtggttttctgtagagataaggtttgattcttttctttttctcctttgtgtgtctgttctacaagtggatttcatacttttgtgtattttcatgatagtaattatcatctttttacttccagatgtaggactcccttgagcatgtcttgtaagggtgtgatgacttcctcattttttttttcatgtctgggaaagacttagtttatccttcatttctgaagcacaactttgctgggtatagtattcttgactgagattctttttcttgcagcgctttgaatatatcatcccattctctactggcttgtaaagtttctgcagagaaatctgttagtttaatagagattcccttaaatgtgacttaacacttttctcttgctgttttttttttttttttttttgagacggagtctcactctgtcacccaggctggagtacagtggtgcaatctcggctcactgcaagctccgcctcctgggttcacaccattctacctcagcctcctgagtagctaggactaaggtgcctgctaccatgcctggctaatttttatgtatttttagtagagacggggtttcaccatgttagccaggatggtctcgatctcctgacctcgtgatctgcctgcctcggcctcccaaagtgctgggattacaggcgtgagccactgcacccggccttctctggctgtttttagaattctctctttgacttttgacaatttgactgtaatgtaccttggagaggccttttttttttttttttttgagacagtctcactctgtcacccaggctggagtgtagtagtgtgatctcagctcactgcaacctgcgccgcttgggttcaagcttttctcctgcctcagcttcctgagtagctgggattacaggcatgcaccaccacgctcggctaatttttttgtatttttagtagagataggatttcaccgtgttggtcaggctggtctcgaactcctgacttcaaatgatctgcccgccttggcctcccaaagtgctgggattacaggcgtgagccaccgcatctggctggagaggacttttttgggttgaatctgtttggggacttttgagcttcctggatctggctgtccatctctctccccagacttgggaagttttcagctattatttcattaaataagttttttatgcctttccccttctctctttggaaatccaataatatgaatatttgtttacttaatgagatcccctaagtgttgtagaccttcttgactgttttccattctaacttttttccctctgactaatttcgaatgacttatcttcaaatatagagtcattcttctgcttgatcaagtctgctgttgtagttctctattgtattttttccttttttttttttttgagacggagtttcgctcttgttgcctaggctggaatgcaatggcactatctcggctcaccgcaacctctgactcgtgggttaaagcaattctcctgcctcagcctcccaagtagctgggattacaggcatgcgccaccacacctggctaattttgtattttttaatagggacggggtttctccatgttgcttcggctggccttgagctcccaacctcaggcgatccacccacctcacctcccaaagtgttgggattacaggtgtgagcccccacgcctggccctctattgtattttttaaactttgttcattgaattattcagctgcaagatttctgtttttttgttatgatttttatctctttgttgaatttctaattcatatcatgaactgttcttctgattttgttgaatcatctatctgtattttcttgtatctcattgcatttccttaagatcattacttttaatttattttctggcaattaattgatttccttttcattggggtctattaccaaagagttattatgttcctgtggtggagtcatatgtccttgtttttttcatgtttcttatgtctctgtgttgataccccacatctggcagaacagtcacttcttccaaactctctggagtggctttcatagagaaagactttcacatgcagttgggttttagtgtgccagttgggaagggtatggcaactctgtttctggatagatgtagtggtatgttttctgtgtagcttcttcagctgcattcaacatgagcaataactatgggtgcctcaagagtcctaggctatagaagtgtggcagtggcagtggtggtatatgttgttaatatccttggtgtcaaggagttttggagtcctcctattctcattttcctcacaatggagtgactcagccaagagaatccctcttggtgtcaggtctgactgacatggcctacaagcagctgcagaggcactgggttccaggtacagatgcgtggagtagctgtggagtcaggtttccaggcttagggtctcacaaacctattgtggcacctgggtattggggtacagatttgctctctgtggcaaggttggatgtaggttgcccacagagccaggatctgaggcacccgctagcagctcaggcccaggggactggctcataactgtgattctaatactgggggataggccatagcactggccttactctgtggaagaaggggtgctctggaggtttgggcctagggagcagggtacagctgcaattcagggatctgagccaatagggctcagtggcagctcaggtcccacggaatgaggcaccatgtagtagtgactctagactccaggatggtggggcttggctgtatcctagactctgtgaagccaagtgcaatggcagcgaataccccagcgtggcagagcacagctgtcatttgggccctgggggtcagggagcagcacagcaatgactccactccccaggaagagggtatcttagcagctcagactctaggggcaagtccagttccagggaagcagggtactggagttgtttggctagggcaaggtatctcagctcagccactgctctgtttcctgggacatggggtactgtgtcagctcagccctggaatgcgtagctgctcagcttggccagccaccaattcccctggggacaatgtgctgctttagcacaggcctagtgtgggcatgactgttctgggtgacccaggcacagtatcattggaatgcagggtgccgcttcaagttaggtgctaggatgcatgactgccctgggtggccaaggcaccatttcctgggatacagattgcttcttcaccttaggcaccagggaggcctgactgctctgagcagtctaagtactgttttcatagtggatagggtactgcttcagctgcagcccaaggggagtggggaggggtaggtggagtggctctgcctccacttggccccttggggaatcatgtaatagctgctcacagcttggcttagattgtcaagacatcaggctagagtggtttgttggtggcttagcctcaggaatgaaggggagctgtggccatctgtccccagagcaaaacacaatcccactgtagctccacttccaagatggcatagcacagtagctgcacaggccacaggggctggcgcatagtattggctccttctctggagggagcacagctgtatggactccaggcagctccttcagctgggcttagtgcctagaggactgtagggaagccagtggtgaagtctgtaggtgtccaaggtgctggtggcagtttctagaattgtcttgcttacttccttgctgtggggagaagttcctccttgttcccagctgatcctagatgggggaagggggatgggggggaggcctgatattgccatctgttctctatgtggccatcctgagtttctgtgctcatcagcattcctgtcacccttctgatacacccccacagtctccctcagttatttttgttaaaagtatagctgtttattactctacctctctttgtgagggggatgtgctttaggggctgctcggccatcttgctgacattactcccctaggctgtttttttttgttgtaactttttaaaaatgtttatttatttacttttgagacaaggtcttgctctggtgcccagactgcagtgcagggtgcagtcatggcttggtgcagtcatggcttactccagcctcaaacttctgggctcaagcaatccacccacctcagcctcccaagtagctgggactgtaggcatgcaccatccctcctggctgagatttttatacttttttttttttttggtagaaacaggttcttgctatgttgcccaggctggtcttgaacttctgggcttaagtgatcctcctgtttcatcctaccaaagtgccaggactatagatgtgagctatcatgcctggccaaagtgagctgctttaataagagtatttgaaattattccagtgtgttttaattccaaatgtattaaaataggtatgatggagtatcggtcttgcaggaagccattcagcttcagtgtgctaccttttctggcatctttctgggacaaattcgtatttgttctatgctggtgagcaagggctctttatacagagctgctgagtgtagcgacctaaatttttttgctcaaacaaggctgttttaataagaaataaattatataaagtcacgtgatccatttagtaaaatattgggctgtgaaccaggagactggtatttagtcacactgattaggtcttacccaataacctttgatcagttgcctctctacttactctatttcatgtgttgtgaaatggcatgatattacctacctctgatctagttgaaaatcttttttttttttttgtgagatggagtctcattctgtcacccaagttggagtctcactctgtcacccaagctggagtgcagtggtgcaatcttggctcactgcaacctccgcctccagggttcaagcgattctcctgccttagcctcccgagtagctgggactataggtgcatgccaccacacccagctaattttttgtatttttaatagagacagggtttcaccatgttagccaggatggtctcaatctcctgacgtggtgatcccaaccaccttggcctcccaaagtgttgggattacaggcgtgagccactgcacccagctgaaaatcttttaatgaatagaaaatctactcagaagtagcagatgaagttagtgatattttttagggtcagtaagagttgataggaaagaagaaatgaacatttctcagttactggccaggtgctaggcactgttaggtgccttatatgtatcttcaaatttaattcttgtaaagtagtcctatgaggtaggtattataaccttcctttgacagataaggaaaatgaggctcagcgaagctgatttctgtacctaaggtcacacagctaataagaggcacggatctgaactttggtcagtctgatggcaaaccctgggttctttctgctgtgttatgttgctacacagagaattaatctgattgttgtttttgttgctttaaagagaaaataaccttacagagactaaggagtaaagataagtcaaaaatgaaaactttattgtatagtttaggaggcagtaacagaaagcagcgtaagtggacttgcagaagcaggggtactggagtttatgttgctaatggatggtgactggtgtgagagcctcttagtgaagtgcgtggtttcctttgtctctattcattgctacctctggccactgacctatcacctcttctctctagggtaaagcccacagcttgaagccaagcataaaggagaagctggcaggcagccccattcgtacttctgaagatgtgagccagcgagtctatctctatgagggactcctaggtgagaaacacactgggaaggccctttgcactggagaaagctgactcagccaggggagagggtcacactgaacaagtagctggttgtctttctgctgatcttaatgctaacattagatagcagttttatacctgaagcaagcgacttactgggtccagaacaagcagtgggtgaaaactggacaagattgggttttggtgttaatcaacagcctttgcctttctgtcttcctttctttcctttcttgctaccatggtccttcctgctctcaaattggcaggaagggacaaaggatccatgtgggaccagttagaggatgcagctatggagaccttttctataagtaaccacatttatttgtgtgctgtgttcatccctcctccttgggagggactgggccttacttggaggcatctggggctggtggcaggcatgttagatctggggtagaaagattgtgtttcctttgccctggaatttgtaattattcccttttatctggattttactctttatttttgtttggcagctatattcttaaatgttaaataggccccctaagaaacctttattctatgcaggcaaagagcgttctactttatgggaccaaatgcaattctgggaagatgccttcttagatgctgtgatgttggagagagaagggatgggtatggaccagggtccccaggaaatgatcgacaggtatggggcttaggaaaccattgggaatcagcaaactcagcctcctcccagttagttctgtggtctcccacttgagggctgacttgtgcttggtcttctccttaggtacctgtcccttggagaacatgaccggaagcgcctggaagatgatgaagatcgcttgttggccacacttctgcacaacctcatctcctacatgctgctgatgaaggtaatgtcaattttgctgtgtccagctccgctgatcctagaggggcaaggcttgttcctgtcgcctaaatttcggggtagctgggaagctatcaaggtatcttaacttagggctatcttcttgattgaaagtctgaggcctctctgccagcttacaaatgttccatttatctgaagctgccagccagttttactaaggagtgttgtaggaagaactgatgattctctttttttttttttttttttttgagacggagtcttgctctgtcacccaggcaggagtgcagtggcgcaatctcagctcactgcaacctctgcctccccagttcaagtgattcttgtgcctcagcctcccaagtagctgcgattacaggcgcacaccaccatacccagctagtttttgtatttttagtagagacagggtttcaccatgttggccaggctggtctcaaactcctgacctcaagtggtccacccaccttggcctcccaaagcgctgggattacaggcgtgagccagtgcgcccgaccaagaactgatgattccatagtatttatttatttatttattttcattttctttttttttgagacagagtcacactctgtcacccaggctggagtacagtggcacgatcttggctcaccacatcctctgcctcccgggttcaagcaattctcctgcctcagcctcccaagtagctgggattacaggcatctaccaccatgcctggctaatttttctatttttagtagagacggggtttcacaatgttggccaggctggtctctcgtacttctgacctcaagtgatcctcctgcctcagcctcccaaagtgctgggattacaggcaggagccaccacacccagccattatttatttattttgagatttatgtggtctctctttactaagtagttttagggtgccaatagagcttcccacaaaatacaatgaattaatttttttttttacaatagtagattttaaaaccttagaaaggatgctcaggaccaggcgcggtggctcatgcctgtaatccaagcactttgggagaacagggcgggcagatcacctgaggtcaggagttcgagaccagccttgaccaatatggtgaaatcctgtctctactaaaaatacaaaagttagctgggcatggtggctcatgcctctaatcccagctacttgggaggctgagacaggagaattgcttgaacctgagagaaggaggttgcagtgagccgagattccaccattgtactccagcctgggcaacaagagcgaaaatccatctcaaaaaaaaaaaaaaaagaaatgatgctcagaatttgtttttcagcacagccctatatcttacagaattttctatagttataaaaagagccactcattaacaaagtaatagtagattttaacttgatttggttgtacttggttttatagctgtggaagaagtatgttaccaagtagaagagttctgctctgaaagggaaacataaatctggagttgatgggtagaagagaattgtttggagaacgagccactgggtttctcctccttctgttctccccaacctccctaagtgtgaagggatcagttgatcaaatgcagagaatgcccccagcccctcttggtgtgcttcatttcctggtgtaagttgcactgtactctgtggaatttggagggtaccagttgactctggctgagaaacgatgatgatccctaaccttcagagatgtcttggctacccagtctggtgttgccactctaagtcattgtttctgaattacactatgaagagccttgggtgtttttagagcccttgtaggggtgaatgttgtggtattgagtggggatagggagaaagtgtcccctggaaccagaaccgctctaagagccacttttctgcagaagctaactagagacagagccaggacttttcttcccctcatggtggcagaatacacagttgaaagttttctcccatgttcagtgatgtggtctttcagaattccacttctctcagatggtgggaagcccacttgtacattctcttttctctacctcagtcgggaggagagcagatcccttgttaagagtcatgtgttggcttttcaggtaaataagaatgacatccgcaagaaggtgaggcgcctaatgggaaagtcgcacattgggcttgtgtacagccagcaaatcaatgaggtgcttgatcagctggcgaacctggtaagcacgtctggccaccccttaggcttccccatgggtcatttcttggtttgtgtcacttgcagtccagttcaccccgtttttgaaaatggagcagttgtctttgactgtaaatgaggcattagtccctgtgttctgtgatgggattctctgtataaaaccatcgtagtgcatcagttttgatgtgtggtctgtgaactgctgagggttcagaaggtgaaaacgatttcaaatgattctaaaatgttatttgctgttttcacggggttacatttgcactgatggtaccaacgcagtgatgggtaaaactgctggcactgtaacccaagtgaagacaatggccccaaactatgccagcagccattgcattccttgccttcatatactctcagtttttcgtttttgttttgtttgtttgttttttgagactgactctcactctgtcgcccaggctggagtgcagtagcgcaatcttggctcactgcaacctccacctcctgggttcaagcgattctcatgcctcagcctcccaagtagctgggattacaggcatgtgcccgcccacccagctaatttttgtatatacatatatattttttgagacagagtttcactctcttgttgcccagactggagtgcaatggcgcaattttggctcactgcaacctctgcctcccgagttcaagcagttttcctgcttcagcctcccgagtagctgaagctcctgaggttacaggcatgcaccaccacgcccagctaatttttgtattttcagtagagatgggcattccccatgttggccaggctgatcttgaactcctgacctcaagtgatctgcctgccttagctcccaaagttctgggattacgggtgtgaaccaccgcacctggcttacactcttagttttttaaaaatgccagttgtgcttgtaaatgtccttgaagaagcagtgaagactgttactcttattagattgattaattataaatgtttttaatattctttgtgacaaaatgggaagtacacataaagcatctctgttgcaaacccagtatgatggttgttttgaagaaaagcaatttgcagccttgatttgttcaccttgagttgcaagtgaacttaatcgctttgttcattgaacatcatttttactggaaaggacaattaataaaccatggttattcagagtacccaactggcagacattttccttcagttaatcaagtgagcctgttgtttcagggaaaacaactgacagtatttgttgccaatgataagattcagcttttaagtgaaaataagaattttggcagagttttgaacttgaagcttcccaatatttaaagacttttctaatgagattggtggtgatattaatgaatgtgattttttaaacattgatttaatattacaaaatatgtcaacatttggaagagctgtgtaactcagtgaaacactattttctttctttttttttttttggagacggagtctcgctctgtggcccaggctggagtgcagtggcaggatgctggctcactgctacctccgcctcctgggctcctgggttcaagcaattctcctgcctcagcctcctgagcagctgggagtacaggcgtatgctgccacacctggctagtttttttttttttttgtattttaatagagacggggtttcaccatcttgcccaggctgtggtcttgaactcctgagtttagtcaatccgcccaccttggccttccaaagttctaggattacaggcacccagccaacagtattttctaaataccaatgtatgatgttgtaaattcaagtatggataaaagatctactcaaaatgcaaggcagagatatggatcttaatttttaaataacattttttttcagtctggggaacatagaccccatttctttttgtttgtttgtttgtttttgagacggagtctcactctgtcacccgggctggagtgcagcggcgcgatctcggctcactacaacctccgcctcccaggttcaagctattctcctgcctcagcctcatgagtagctgggattacaggtgcccgccacaacgcccggctaatttttatgtttttagtagagatggggtttcaccacgctggtcaggctggtctccaactcctgaccttttgatccgcccacctcggcctcccaaagtgctgggattacaggtgtgagccaccgcgcccagccaagggagaccccatttctacaaaaaataaaaaaattagctaggcatggtggcatgcacctgtagtcccagctacttgggaggctgaggtgggaggatcacttgagctcaggaggttgaggctgccgtgagcaccactgcactccagcctgggtgacagaatgagaccctgtctcaaaaaaaaaaaaaaagtgtatggagaatagggtctcactttgttgcccaggctggtctccaactcctgcctgggctcaaacggtactcctgacttggcctcccaaagtgttgggattataggaatgagccaccatgtctggcctaaatggattttaatgtaacaatgtaaaatgttcattgatgtgctttcagattccacactgcaactaactttcaaaagctgcttttgctgggtgttgtggtttatgcctgtaattccaggtacttgggaggctgaggcaggagtgtcacttaagcccaggagttcagagctgtggtgggctatggtcatgccactgcactccagcctggatgacagagcgaaaccttgtctctaaaaaaaaagaagcttctgcttcccaagttctggtgtagtgttaaagaagaatacgtctatttatctgaaaaggctatgaaaatcctcttccattttccaaatacgtatctctgaggtcaagtttttttcatatacctcaaccaaagcaacatactgcaacagactcaatgcagaggcagataggagaatgcaactatttgattctaagccaaacattaaagagatttgcaaaaatgtgaaacagtgccttttttttgaaaatatagttattttattaaaaatgtttatattactatgtaatgggttatattaatcattaattgtttttataattaatcatttgagaaatttctgtttaaatttctagtatgtaaatatctataaatataactcacataaacaaaagctctttggaatcttcaataaattttaagagatatagggcctctgagaccaaaacatctgaaaccacttccctggtgaccagtggccagcagatgagactgtgctgaggaagccgatatgaatttgattgctggatggggaattcttggcccagagccctctgagagggatgtatgactgtccctaaaaaatctctctttcatcagaatggacgcgatctctctatctggtccagtggcagccggcacatgaagaagcagacatttgtggtacatgcagggacagatacaaacggagatatctttttcatggaggtaggtgctggttcatgctgggggcccaaagggctattgagagtcacagggaactcataggaccgatgccaggatatttttctcatttatctcattcatcttcatgatctatttatcattaaattatcagattggtttttttgttttttgcgtgtgtgtttttttgagatagtgtctcgctctgtcacccaggctggagtgtagtggcttgatctcggctcactgcaacctccgcctcccgggttcaagcagttctcctgccacagcctcccaagtagctgggattacaggcgccagccaccaagcccaggtgatttttctatttttaatagagatggggtttgatcatgttggccaggctggtctcaaactcctgacctcaagtaatccacccaccttggccttccaaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaagcaattctcctgcctcagcttcctgagtagctaggattacaggcatgcgccaccatgcccggccaattttttgtattttagtagaggtggggtttcaccatgttcgttggccaggctggtcttgaactcctgacctcaagtgatccacctgcctcgacctcccaaagtgctgggattacaggtgtgagccactgcgcccggccccatttcttttatacacgtgcgcgcgcacacacacgcgcacacacatatacataaagatatctatatatagatgatatagtcacattgttcataaatcagaataacagaaaatagtacacattgggaggtcttgcactcattcttgtccccttccactgaatttcccactcccctcaccccttcatcctatagacaaccacttttattggtttcctttgtaaattccagtggattttttttttctttttctttttttttttttttttttttgagacggagtctcactctgtcgcccaggctggagtgcaatggcttgatctcagctcactgcaacctccacctcctgggttcaagcgattctcctgcctcaggctcccaagtagctgggattacaggcgcccaccaccgcacccagctaattttttgtatttttagtagggatggggtttcaccatgttggtcaggctggtctccaactcctgacctcactgatccacccgcctcggcctcccaaagtgctgagatcataggcgtgagccggtgcacccggccttccagtggacttttatgcaaacaataaaatatgaacacaaattcttattttcctcctttcttttttttctttgagacagagtgttgctcttttgctcaggctggagtgcagtggtccaaactcagctcactgcaacctctgccccttgggttcaagtgattctcctgcctcagctgcctgagtagctgggattacagtcgcccaccaccatgcccagataatttttctatttttagtagagacggggcttcaccatattggccaggctggtctcaaactcctgacctcaagtgatctgcccaccttagcctcacaaagtgctgggattataggcgtgagccaccccgcctggcctatttttctcctttctttcagaaagatagcacatcttatccattgctttatcccttgcttttttcatttaacattgtcctggtcctcttctgtatcagtaccaagaaagctttcccattggttttatggctacatgtattccactgtgtgactgtgccttaatttatttaaccagtcagtacatatggatccttgggttgcttccaaatttgctgttactgatagtcatactgtgaatgatgctgtgcctgcttcatttcatacatgtgcaagtgtgtctaaggattcccagaaatgagattgctgggtcagagggacaatgcatttgtaattttggttgatataattcttaagtgtctcataacacgtaataccccctttgccattaattttgttgaagaaattggatcgtttgccctgtggagtctcctacattctagattttttgctgattgtgtctcctttgtattagcgtgtttcctgtcacatatttctcatagactggtagttcagtttagaggtttgatcactttcagattcactcttttgggaagaatacttaatgagtggtgctatacgcttcctattgcctcatatggttgtccctctcttacacatcagtgggctcagatgtgggcaacctgatctgcccaccagaaagttcctcatttgtcttctgattttgcctatggtattttttgacacacataaattttttatttgtatataacttttttttttttttgagacagagtctctctctatcgcccaggctggatgcagtggcatgatctcggctcactgcaacctatacctcccgggttcaagcagttctcctgcctcagcctcccaagtagctgggtttacaggtgcctgccaccacacccggctaatttttgtgtttttagtagagatggggttttaccatgttggccagggtggtctcgcactcctgacctcaagtgatccacccacctcggcctcccaaagtgctgggattacaggtgtgagccatcacgcctggctacttttatataattaaattaatcaatagtttcttttacggcttctggattttgaggcatggttagaaaaagccttactctccaggattataaaggaaattggccgtgttttcttcatttctgtgtttttaattctgaaacagacctaagtaattttaaggaccaaatacaactcctatatataaagtagtaaaattttgcctatgttatctgttcccctgtggtttagctgaatttgaatatcacattcacagtttttttgaacaggtggtctaccaaacgcaagaagggcttaccctgaagcagaaacatacatgtcagtgtagccaagaaggagtcattttcatgtcaccctttaaagtgttagaatttggctagttgcctctcagagcctagggctgacttaggacatctgcaccacagcagaagtggcacatgactcttgcccttttcttttccttttaaaaaaaatatctccagcagattccttgaactactcttactctcaccaccgtacaaagggagcctcatgctaagtctctggagtgtgggactggacccattacccaaatagatgcctcttcctcgaagtggtgccatgccagggaagagtgcaccatggtcactgtgccatcacctggctcctgtgaggctatttgatttagcctttctcagagcatagcctgctttttgcatgatcaactggacagcagtttgggaattttttttttttttttttttttttttttttttttttgagacagagtctcactctgttgcccaggctgaagtgcagtggtacaatcttggttcactgcaacctccacttcccaggttcaagcgattctcctgcctcagcctcctgagtagctgggactacaggcacatgccatcatgtctggctaatttttgtatttgtagtagagacggggtttcaccattttggccaagctggtctcgaactcctgacctcaagtgatctgcccacctcagcctcccaaagtgctgggattacaggtgtgagctgccacacctggccaaggaaaatatatatatatatataattttttttttttttttggaggtggagtcttgctctgtcacccaggctggagtgcagtggcacaatcttggctcactgcaacatccacccaccgacttcaagagattctcctacctcagactcccgagtagctgggactacaggcacgcatcaccacgcttggctaatttttggtatttttagcagagatggggttttgccatgttggccaggatggtcttgaactcctgaccttaagtgatccgtctgccttggcctcccaaaatgctaggattacaggtgtgagccaccatacccagccaaagatttttaaaaattgtctttgttgccctttttttagttacagaagtaaaacagtatatgctgtaaatgtttcaaaccgtgccaaagttaaaaaataattaaaagttttactcactgcctttcaatcctttgtcccagaggtaaccagtaatgaagagttttatgtgactcctttcagattattgaaaatgcatatttgtgcaaatataatttatttatatggaattttgtttttgcacttacgaaagtggtatcaaattacaaatattgggctgggcatggtggctcacatgagcctgtaatcccagcacattgggaggccgaggcaggtggataacttgaggtcaggagttccagacaagcctagccaacgtggtgacaccctgtttctactaaaaatacaaaaattagccgggcgtgttgggcaggcgcctgcaatcccagctacatgggaggctgaggcaggagaatcgcttgaacccggaggcggaggttgcagtgagccgagatcatgccactgctctccagcctgggtgacaaagcgagactccatcgcaaaaaaaaaaaaaaaaaaaaaattacaaatattgttaaataatttgcttttttcacttaatgatatacctttccgtgtctttttttttttttctttaatggatgcttagccattagatgtcgtatggtgtaccataattggtttaactagtgcctctcactattttttaaaaaaatattactcatgctgggtgtggtggctcacgcctgtaatcccagcactttgggaggccaaggtgggtggatcacgaggtcaagagttcaagatcagcctggccaagatggtgaaaccctgcctctactaaaaatacaaaaaattagccaggcgaggtggtgggtgcttgtaatcccagttacttgggaggctgaggcagagaattgtttgaacctgggaggcggaggttgcagtgagccgagattgcaccacttcactccagcctgggcgacagagcaagactccgtctcaaaaaaaaaatttaaaaaaatgaaatatatatttatatattactcattaggccaagcatgttggctcacgcctgtaatcccagtactttgggaggctgaggcaggaggattgcttgagcccagagtttgagaccagcctgggcaacatagggagaccctgtctctataaaaaatttaaaaattagtcatacatgtggtgatgtatgcctgtggtaccagctactggggaggctgaggtgggaggttcgcttgagcccaggaggtcaaaaccagcctgggcaacatagggaaaccccgtctccacaaaaaattttaaaataagctaggcatgctagtgcatgcctatggtcctagctactggggaggctaagttgggaggatccttgagcctgggaggtcaaggcttcagtgagctctgattacaccacttcagtccatcctgggtgacagagcaaaaccctgtctcaaaaaataataataataataataattgctcattgaatatccttgaacatatatttttgcaccctcacatgagaatttctataggatatagtcctagacatgaaaatttcaagtcaagcttatatacgtttaaaatttcggtagattttgccaaattgccatcccaaaaactataccagtttacacctccaacagccacttagacgactataacagtatattacaagcatttctctagactagaatgctctagcttagaaatcatgtgttctcctaaatgtgttctgcctgcctttacatgatgttcttaaaggattatgaaaggtggagtggtattgtccattttccccctggagataaccacagagtcagactgggcctagaactcaagtttcccattcctactctgccactttgactgattcttcaaaggctttagaactccagtaaagtcttatacagtagcttaaacctgatagtcttgtgtgttccttactcactcacctaatatttgtggagcacgtattatatgctaggtactttgttgggtgttgggattatagcagtgaataagacagacgtgatttctattgcccttagcattgacaagctattggggaaatcagataattaaagagtattataaaatatggtgagcattatgaaagaagctcagggggggcagaataaataccagagggcctaggagctgtggacaactcctttgagaagttgacctttgagcttagacttgaagaaagagtaagagttaatggttggggagtggaagagcagtcagggatatttgagctagaaccaatgggactcagtgatggagtgtagttagttagagggaagaggaaggagtcgggcatcaattcttcatttcaggctggggcagctgggtggatggtggtgccatttcctcaaatagcagacttaaaaggaggatctgcccaggaggagatgttgagttcagatttggacacaatgagtttgaggtgctacatgtgaagcatccagacactgagaagctcaggagctcaggaagagaggtctaagatggagaaaggtaagaaccatcaacatggtaataatcattagtatcatagttctgatatctagtagctaattagggtactttctgtgtgcctggctttgtgtgcaccttaaatactttatgcacattaactcatttagtcttcatagtaactgtaggaagttattactgttactatccccatcttacctgtgaggaattgtggacacagatgaacttgctcagggtggcacagctcagtaatggcagagctggaatctaaactcaggctgactttagacctgtgcccttcaccattgtgctgtaatgtctcccgtaacatttgaagccttaagaacggataactggctgcgcatggtggctcacgtctgtaatcccagcactttgggaggccgaggcgggcggatcatgaagtcaggagatcaagactatccttgctaacacggtgaaaccccgtctctacttaaaaaaatatataaaaaattagccgggcatggtggtgggtgcctgtagtcccagctactcgagaggctgaggcaggagaatggcgtgaacctgggaggcggagcttgcagtgagacgggattgcgccactgcactccagcctgggcgacagagcgagatccgtctcaaaaagaagaacagataacttcacctgaaagagaatgttgaacaagaaggtgtcaaagatatttgctttttaatttatatcatcctgtattgtatcatttttatgtaataagcattgttcatgtgtcacttgtgtaattaatttttaaaaatatttttatagaaaaagggtagacccaggattagaaagtgcatcagctccatttttctccttggttaagtctgtcatgatctcctacctttgtgtttgtcaacaaagatgattcctgagcttgtaagatggaggcatgagatctcctccaaatactttaagtccgtagagcacataagaggtaataaataactgggccgggcgcggtggctcacgcctgtaatcccagcactttgggaggccaagacgggtgtatcacttgaggtcaggagttcgagaccagcctggccaacatggtgaaaccctgtctctactaaaaatacaaaaattagctgagcatggtgatgtgtgcctgtaatctcagctactcgggaggctgaggcaggagaatcattttaacccacaaggcagaggttgcagtgagtcgagattgcaccactgcactccagcctgggcaacagagtgggactccatctcaaaaaaaaaaaaaaaaaattatagccaatgtgatggtgtgcacctgtagtccctgctactttgggggctgaggcaggaagaacctggctggtcgaggctgcagtgagctgagatggcgccactgcagtcaagcctggggtacaaagtgagaccctgtctcaaaaaaaaaaaaaagaggtaataaataactgattgatttgtgcctcctcccttatacatcggttccttctaatgactccatctcttccaacaatccttgtagcaggcagcatgtcagtagttctgttttgtgtcttcacctagggaaaccatgagcgtaaggcagaaaacctgaccatggggatgccccaggaccacctttccctgtaggaaacagtctagggagaggctgtcagagacaggaaccactgagccgctttgtgcacttctccaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaaggtacgcaggatctgtgtttgggttggggctagtaggcattgaagaccaaatagtgaatttctctttgggaagttaaaattccaaaacacacatctggagccacacttctgtctccagctgttgggtggagtacctaaagctgtctctgtcaagccaactaggcctaatagtagtcacaatcggtattaaccaaccatatctagcattcctacacatctgtacccatgccttctttaaagccatactattcatatgctccggatctatcattcataacctcaacaatgaataagacatccgaaaaataggaggactacttaaaattttacccctcacttcaacctccagccttcagtggccattatagagcagtgggtggggaaccctggacagccctcatgatgggaccactctccccctgtgccacagtgtcgggagctgtactactgtgtgaaggacagcatggagcgcgctgccgcccgacagcaaagcatcaaacccggtgaggagagtttttcctgagagtgtcttccctgtttctaccagtccttctgagtgtcaggggcctggcagggaagtcaggggtgggattccccacctcaccagtgagctgatagccccctccctcaccacaggacctgaattgggtggcgagttccctgtgcaggacctgaagactggtgagggtggcctgctgcaggtgaccctggaagggatcaacctcaaattcatgcacaatcaggtaggtgcgagcggcagcacgaggctccctgtcgttccatctgtaagaaggaccaatgtccaagcccccagtacttccccagcaagcatgagagagggccctctggagctagagggagaactggagcagctggacccaggaaagaaaccccaggggagggcacagtgacgttggcgaccacctggcgctgtgaaggtgcaccagggagcccgtgggggaggctgggcaggagcgaggccaggtggccacgctgccccatccgttggactccacacagtgtgagtgggagcgtctcacttggcccttcccctgcagtgtctctgccttcctctattcccaggatatgcttctgcttggtggttttgctttgagagtctagactggccgatctccttgtgtctttctggtgtgcgtgcagcttgcgtgtgcgtgcgtgcgtgcctgcgtgcttgtgtgtaagtagcttgtatctgtcctctctggagtgtgtttatttgcctttttcttctgcggattcttcttcctgttcttttccttcctctgagtgttcccactctgtcccctgctccacaggccccattccctttcttttgattggggagcacttgtggatacatctttccctcattgtaattccaccataggagctgacttttttttttctctcttggtcttttaacacagtgttacctttttctctcagtggacattccttaagctaattcctttctgaggccagcgcatcatcccaggtccgttcacagctctgactcctcacacaagtgccttccctcctctttccctgatgtccgggttcctctccctgaggctctgagccagacccaaatgtgtgaagccccacagaccctggccaggccgcagaccctcaggggaggtggatgcctgactgacgtggctgtctccctccctccgctagccgttgtagctctctttcaggaacgtagctgggcagctttggtttaacaggaaatggctgcgcaggctgccagcagccccttagtatattttcaatttaggacttagggcagtagccaaccccaaagaccttaggaccatcccagagaggggtctacctaagtgcttttctggaccacaaaggtgtcagtacttcttggggagcagacttctgaccacattttagcgccgtggcctctgaagatgagatcttgctgagcaacgcccaggtgctctgccctgttcctcgtcctgcccttggcatagccccactgggcagccatccaagccagtctgtggttgaaggcttggcccctagaagatagactgcagagaaggggaggaaagcccgggttctcaatctcacctcacagttagtaatgagatagcgacctgccccctattctgccacacagtgttcagttggagtggaggaggcagcagacctcctggtggagctgtgcagtctggggtaaatgggaaaagcacaggcttcggtgtgaggacatgcttggatttgaagcccagcttccacgttcatgggcaaagaaactttctgatccatagtttcctcatgtagaaaatgggggtaatactatttactgtgtcacgtagtaggtgcagagattagaaatcgtatttgtaaaaccccaagtaggtgctcagcaagtggtagctgatattattatcaccacatacctcttgggagatcctggatcctgtttcaaggaggataccaacacctcccaccctgaggacagtctgaggggagctttgcgcccgtgccagccctctgcgccggaggaggatgcatggaagggtagagacctaatgggctgagtggggacccctggggcactgtgtcttacaagcactgccctgggcagagggtacgggcgggcagcccaggccagcagcagggccttcgggttgggtttgaccattcaaactaacgccttcatttctctcccatgctttctcctccggccaggagcggaaggtacatgccctttctgctatcttcgcttcttagcgcttttgagttgtgtgcgtgtggattcttctgtcctctctttgggaaatagactttctttgtgtgggtggggctgtagctgggagagtgtgctgtgtggggcaggggtggagcctgtgggccttaccccggcctccctccctctcttgcaggttttcatagagctgaatcacattaaaaagtgcaatacagttcgaggcgtctttgtcctggaggaatttggtaattacactattttgctcttaggtctggactcacatggcagtaactcaaacctcggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaaatggggcctcaggtgggtttcgagtttagaggtggtcctgaagcagctcagtgaagtagcaccacctccccgtgctgggccagccagtggtcagaaagtttgggacacagcagactggcgacccccaagctccactatgtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcgaaccagctcctcacactgccagctcgtctcttcctttctcccctaccctctttcttcctaccttgcctcccccttctcaccggctcactggactttcctccccgtgtgttcccttctctcttctgtcagagagatacttgggggaatcttccaactcgggagaatggcctggggcttcttgctctacctttgatgagtttattccctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcagaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcacacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccacggtgcgcagggctccctgggggaccttcggacaggaggaggggagggccctctgagcgcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatggaggagtctcagtatcgtgatccgcctggttttctctcctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcccttcaggctccctggctgccttgtgttaaatgacacctcctcttggctcaggcctgaggaaagctatccctggactctaaaaagtcacctcaggctggaaggaaggaaggagatgaggtcatccatgtccaagctttggcacacggaggccccagctcccctgttctgggctcctagagcaaggctgcgggaggagctttccttcctgggcacctgagggccctgcagagagctgggctgccatgaatgaacaggctgctagagggagcagccagactgggcgtcctcacctgaactgagattaagtgaaagaaagccaaggccctggccctctccgttcccttacaggtgggtatggtcgagagaggtgtggtgattcagccagggcctcccacagggccccggactcctggccaggagtgtcttccactgcatagaactcccagaagctcccctaggagctgccttcatggaattctgtcctggaaaaacctggctgcactctcagggaatttgagacctgctggcttcccgcgcccaaaaggaaacagatgctcggatttaggctccccatgggggaagtgagagcagagtggggccctggccctgacacctttctggtgcccagcgtcctggactggattgggttgctgtctcccaccggggatatgggtctgaacccgctgctggcttattgctggctgggactccaaagccacctagtgcagctccaccccagcacaatcacaacactgagattctgcctcaccccacctccaggcggttgtgaccacggcccctggcacaaggatcacgctgagcacctgggaccagttaaatgcactttccgctgtcacagctcagtttcatcatctgaagagtgaatgctgtaggggaagacaggttccttctagcgttaatgttttatgaactcagaaaccactctgggcctggtttaatcatcgggaaaacaaaacaaaaaacagtatctgctctcactttgctgtgaagatcaatgtccctgggcttttttctttttttttttttgagacatggtctcactccatcacccaggctgaagtgcagtggcatgatctcggcccacctcaaactctacctcctgggttcaggtgattctcctgcctcagccttccaaatagctgggattataggcgcgccaccttgcccagctaatttttgtatttttagtagagacggggtttcaccatgttggccaggctggtcttgatctcctgacctcaggtgatcggcccgcctccgcctcccaaagtgctgggataacaggcatgagccaccgcacctggccatcccctgtgcatttttatgaaaacaggcacaccgaaattgagaagagtgagttctctgtgactgcacttatcttttattgcccaataaacattgggaagacatagcaggccagaaaggcctgtccccagacattgtttcttgaggccaccctccttttaccccaaagatccaggggcttccttcaggagccctgtggaccagtctgtgcaacacccactcaggactgcccgacaactgccctgctgatcccccatcgcagcacaggagacacacttgtcacacatacatccaacagtagggaggggtttccccaacttccctccaggctcctggcacggggctggcatccggttgtacctgcaacacaggttatcttacgagtgaatggagggcccctacagcctcccatttactgatggctgccccaggaccaagggccagggctcagccactgacttgtgccctgggtgtcgggtggtacatacctggccatccccaggagccagcctggtcactgaggcactgcagaagaggaggccatgtcactgtgtcctcccagccttctggaagctattgcccatctgggcgtggcagggtccgtgcccttgcagccagggcaggtgcttggccgaggacaacggagcaaagcccagggtccccactgccgcccgctcttcccatctcccaggccctggccccgagggctcctcacctcgcacctccaggcggcactcacaccgtgcctcgccctgtaagttggtggccctgcagacatagatgcccccgtcaaaggggcagggctttctaatctccagagtcaacactccctgcttgctgaacatgcggaagcgggcgtcttctcccaggtccaggccattcttgaaccaggaaatcttgggctataaataaggtaaagagagggagggaagccatccaggctgagaggggacctggcagggacccagggagacacatctgtgtttctactcggggggtcccacgagagtccctgactatgcccaaggctggaaacaaacatggaaccaagagtgagtaccatggccctgcccagggggaggaacccggtccatacaccccaaggtggagagaaagcaggggagacaggctggggagaggactgctcaacgtcggggcctgtgagccctgcctcctggtcggcctggaccagcgcctaaagttccctaccttggggctaccccggacagcacagcagagcatagcagtgtagcccgcgatgaccgagcggttcaccaggggctgggtgaagcttggggcctcggagaagtccagggccttatagttgggtggctcataggtgatgcctgttggtgacaggacttggtaccgagagggccacacaaagctaggcccctctccctgttcccacagcctccctgccccagcccctggttggaagaatgagggtacagcacctggtctggggataaagacgggctccttggtggtggccgctctgtcactaaagccaaccatattctggctgaagacgcggaagtagtagccattgccaatgatgagctctggcaccacgcagtgggtgcggcggtaatgctccaagacggtgaaccactcctgggggcagggagggaggggaggcatctctgggccaggcccttcctgatgccgagagcctctcctgggtgcccttggcatctccacccctactatggagggattcagatcagcagagggagggtgaggggtccacggtgaggacagtgaagggtagctgcggcctgggtctgccgggcctaggcagggtgcacgtggggaccccagaccctgggctcaccatggtcttcttgtcggctttctgcactgtgtacccccagagctccgtgttgccgacatcctggggtggcttccactccagagccacattaagaccccaggcgtcagtcacccggagatcctggggaggacttggcttgtctgcgggagacagacccagttgggtcaccacgcctcctgacagtgagcagggggtcactggctccagggaccaccccacccctgccaaccagggccaggcctgctggggcagtggactggaaaatgtgagctgtgggttgggtcccctggccccacccttggccccagcagcccagcccagggaagggaaacaagggggctcaaggaggccttggccacgcaccaacaacctgcagcaccagcgtggccttgtcctccatgttctcaatgcgcaccgtcacctggtaagtgcctgaatgcacgcggcgagcggcccggatgaacaggatggtgtctgtggggctgttgcggatgctcacctcctcgcctgccaggggctgcccctctttggtccaggtcacctgaggccggggcttgccctgaggggaggaaaagcttaaccctgaacctggatcactccaagggccggccgccaccccagcctctggtacctcagatcaggccagccctgagacatcagtccactggatgggaacaacacactatagcctctctcccctgggggacagggaagggggccagtcccacctggaaagggatgagaaggttcacaggctccccgaccttcttctgaatggtctggcgcaggtgcctgggcagctgaagccgtggccgttctgtgggtatagagtgggtagctaagtgagggcccgccacagctctgaggggctccacagctccaacctcccttgagacaaggcccagagagctgcagctaagaaaaaagctgcctgctgggccctgcgcctcctttagctcctgctaacacagcaactccaggctgcccaagcccagctggcttccccgagcctcaccacttcaaaaggcagggatcagagagggtaagcaacttgactgaagtcacacagctagtaagtcatagaccagggtgtaagcctgggctttgacaccctatgccctgtgttgttaccacctgagtttgctgcctcgttccagctttgagaaccaatccttacaaaagatggaccctttgttgggacaaggaacaaaggaatgggaagtggatcccagagggaccaatctgactacatagacaatatttacctgttggagctgagacactcctggaagagagcttgggtactgtggcttttactttccctgttccagaactaagggactgacatacaccaagagagccctttctgcactttttttttttttgagacgttgtctcactctgtcacccagactggagtgcaatagtgtgatctcagctcattgcaactgccacctcccgggtccaagcgattcttctgcctcagcctcccaagtagttgagggactacaggcacgcgccaccacacctggctagtttttgtatttttagtagagacagggtttcactatgttggccaggctggtctcaaactcctgacctcaagtgatctgcctgccttggcctcctaaagtgctgggattacaggcttgagccactgtgcctggccaccctctctgcactttttccctaggcctagcgcatggacgatggctccaacccctcctgtctctgcccagcgttctgggcagagcattctgggcctccccaactgtccccacctccactggacaccaagggcctggggtgtcaatggcgggtcttgtgactgcacaaaggggcactcacgcaggatctcctgcactgtcaccggctccgtggtggtaacaggggctccaggccctgccatattgtgtgcccgcactcggaaaagcagccgggcccccgtgggcaggtccttcaccagtatcgatgtgtgctctgtcagcccctgcagggcagccacccactctgagcctgggggtggggagggggaggcaaggccacaggctgtgtcaccactgacaccccactcccactgcccactcctctgataggaatctccaggatttaaatatgtttttttaaatttttatttgtttatttatttttgagatggagtttcgctcttgtctcccaggctggagtgcaatggcatgatcttggctcaccgcaacttctgcctcccgagttcaagtgattctcctgcctcagcctcccgcgtagctgggatcacaggtgcccaccaccacacccggctaattttgtatttttagtagagacggggtttctccacgttggtcagactggtctcgaactcccgacctcaggtgatccgcccaccttggcctcccaaagtgctgggattacaggcgtaagccatcgcgcctggccttaaatatgtttttaaaatgtagttgctgatttcgcactgctcaaagaagtgttacagtcagctttactctgcatttgtttttcactaggcaagcttttttacttctgaaaacaggacagatatttctctgggtgtcctcaactttcggcaaaagtgggcctaaaaaacttgactacaggtgaatctgctcaatggcaaggtgagcatgttcttcctttggggaggggggttgggggcggggacactcacagccctctgggcagtactccacgctgtagccatccaggcctcctgctcccacgcgctctgggggccgccacttgagggagaccgtggtgtcagagacgtcctctactgccaggtgggtgggttcgctggggggacctgggcagaggagaggtcagagaggggtctgagcaagcctggggaagctggagatccatgccctagactctgaactgcccactggtcacatagggggcacttcctgttcagctggcttttggccactttaaggaatattttgtccctgttacaagacatgtctgtagattggcttaaaaacaaacagcaacagcagccaggcacggtggctcacgcctgtaatcccagcactttgggaggccgaggtgggaggatcacctgaggtcaggagttcaagaccagcctggccaacatggtgaaactccgtctctacaaaaatacaaaaattagctgggcatggtggtggatgcctgtaatcccagctactcagaaggctgaggtgggagaattgcttgaacctgggaggtgaaggttacagtgaccccagatcgcgccaggactgcactccagtctgggtgacagagcgagactccatctcaaaaaaaaaaaaaaaaaaaaaaaactaaaactaaaactacagaaaacatgggaatttcctggcacgtatgattaggtgagttgactaagaactgaacaaaccaggaatcagtccctaaaacgagaggcctggacccttctccccacaggccccgattcctgccatcttcccaagctgtgccccatccctgggcccaggggtccttggcctgcccttgccacaggcagctgcccccggactcacccaccctagtgggaacaggtgtcctcctgagccctgccacagtctcaacacctgttctgcccactcagaccccattatacagatgaggaagctgaggcttcagggagggatgactccagttggccccccggggaccatggagctgcctctgccatctctgagtcttggtccaggactctttccacagacagatgcccctgagacccctccactaactacagcccttgccccatcccataggtgaaaaccctgggttgaagggtgtggagaacaggggacaatgaacatttattgagcacctgttagatgccagatggcctgcctggtcatcccatatcatcctaacagctctctgagataggcagtgtcattattcccattttgtagacatggaaagagaggcttgaaacgtgaactaggggtcggcgtagtgtgagagtcagctccaccccaaccagctgggagatctcaagcaggtcatttaactgcttggagcctgtttcctcatctgtaaaatgcggctgagtatccccagtcgaggatgaaaggagactgtggatgtgagtgtctagcatggctgcctgcagagcacctgctattattggaggtttttaactggggagggggcggggggcaggaccaggccaggcaggctcaccgataggcatgaagggctgggaggcagggctgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttcttcttgcgctccaggatgtagcctggctcaggggaggtggcagctctggtctggaacccaggcatccccacaccaccttccctcggatctgtttggcgccctcacacctccatccggtgcccttgcactcacccaggatgggctgcccgccatcgtaggcaggcggctcccactgtactgtgcaggagtcctctcccacgttgctgatcttgggggccgcaggtgcgtctggcacgtctggatggggtgggatggacccacatcagccctgccccgctcagggccttgagtaacgttgctcgtccccttcccactccaactaaccgccacaggctgcccccaccacccccagatccaaagagatctttctagaatgcatttctttcttcttttcctttttttttttttttttttagtgatatggagtctcactgtgttgtccaggctgggtctcaacaggatgcatttctgatcatgtcgccagccctccgtcaaccctttaaggcttctcactgcccatattcacccctgtcctggctctgatcctcccaaccccacccagtcctctcctgacatgtttcattcattctccacacccaaaaggccctttccctcctccacccctttgtacacagtttcctctgcctgggatgcctttcctcaccatcttctcagcctcctaaaggcatcacccccaggcacagggatggctctctgctcagtgctcccacggcactctggacatggctcatgtacagcagtgtcgcaggaaatctgctggatgcatctgcctccatctcccccagagcggggctccttttgggcagaaaaacctgtcctgttgccgctcggctcagggagcatgcccgtgatgtttgtcgagtggctgaatgagcgaacggatgggccctccttggggctgcccctctgtgttctccagcttggaccccggccggcctcaccgatgaccttgactgtgaggttgacctggtcctcgcccacagggttcttcactgtgaccgtgtagacgccctcatcttccttctctgccccctcgaccgtgaagatgctgcggtccttggtggtctccacgcggacccggccctcggtctcacacagcagctgggggggtgcagagttggggtgagatccaagtcagaccccagaggcccttgcagcctccgccaacagccagatgtcccgggggtccatggggggaacacagcctgtgggaagactgcatccacgtcagcatctagttcaaaatcatctctgtggcaccgactgagggcaggggctcgggttctagctttgtcacgggacctggggcaaccacctgtcctctcagatgagctatcatgaggacccctcaagaccccagccttcagaagaaccaacagtgccaggcaggagcaagaccccggcagctacactggcagaaaagtgtctcagaaactactcctgagttgagagggagcacaaggtcaaggtcaaggtcagcttaggatgaagggagccagggagcagcccagtcatgagggcttcctggcaatgagagggtgtccacatccttgtgatggccatcagcacacttcacagagaccctctgcctgaggtgtgagggccccacagggaccctgctgggggcagcaacacacccggccaagtgtggcacctccatggagacctcgccaagggctcggcaccacgtaggtagaaagtgatgaaagacaaacgagcctcctcctgacctcagtctcactcaccttcttgtcaaacacccactcatcgctgtcacctgtgtcctctggggcatctggggctggcctggctggggccttattcccctgggaacagggcaggagggaagtagggagcagaggagctgactcagcctggaagcgcccctctgctgcttcttccaccccctgacccacactgcccaccttgcctgccccctgaccagtctctcccatggggtagccaacagcagggcgtgcacatgtgggtggggtgtgcagcaggtcctagcacttggctggttccacacacccatcttatagatggggagactgaggagggacccacagtacctgcgtgatagccttctgccagatcacagtgggagcagggtccccagagatagggacgtccagacgtagcttatttccagctacaaccacaatggtgtctggtatgcggcctgggcagtccaggtggatcttgggaggttctgcagaagacacaatgtagttcagagaaacgggagagccaggaggagcacaggtcactggggcggggctgctcaagagcctgggcccctggttattggttttttagatttgtattgaggtatagtttatgctcagatctgacagtaggctgagttctgacagatgaatacacccatgcaattattaatccaaccaagatctggaacattcccatcaccccaggacgttggctgggaggct
